United States Patent 7,745,391 (HUMAN THROMBOSPONDIN POLYPEPTIDE) - sequence listing, part 269

SEQ ID NO: 781554 - protein, 155 aa, Homo sapiens
FDLERSLSDDAERPKFTKLIWLWLKSGNHCTHFGVKKTFGWENKFKLTEILQEVYKELLNPAPSAFPGVNMLHLCSSTFFPTSPFFPELFERYLQTLCPFTFKYFRMHFLRARMLSYTITVHLFNSRDFTLIHYSYLLNSPQSIVPSYIEFFRCF

SEQ ID NO: 781555 - protein, 144 aa, Homo sapiens
GRKKPVVAQSESKASEAEKPKVQPSVCGRRPRSPCKTTGVSTRVQRLKNLESDVQGQEERREHPAREKNESRTQQASLAHLLLAALFYSLWQPLDGAHPHRGWVFFAQSTESNVSLLWQHRHRHSQKQHFTSYLGILQSNPADT

SEQ ID NO: 781556 - protein, 99 aa, Homo sapiens
VYILRVFSCKRQHRVGAHSAGFLSLMPAPPLTCGAGNPGDRQGQSVAFALRHRGPSQPMTGDSRLDRSCWEAEIRSSRYALHGAMRAYNGGIVLELGCF

SEQ ID NO: 781557 - protein, 81 aa, Homo sapiens
MKKIVENSLDAGATNVDLKLKDYGMDLIEVSGNGCGVEEENFEGLMMSPFLPATYRRRLGLDWCLITMGKSSRKPPTPTPE

SEQ ID NO: 781558 - protein, 726 aa, Homo sapiens
FSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGEKPYECSDCEKTFAHNSALRAHHRIHTGEKPYECNECGRSFAHISVLKAHQRIHTGEKPYECNECGRSFTYNSALRAHQRIHTGRKPYECSDCEKTFAHNSALKIHQRIHTGEKPYECNECEKTFAHNSALRAHQNIHTGEKLYECSECGKTFFQKTRLSTHRRIHTGEKPYECSKCGKTFSQKSYLSGHERIHTGEKPYECNVCGKTFVYKAALIVHQRIHTGEKPYECNQCGKTFSQRTHLCAHQRIHTGEKPYECNECGKTFADNSALRAHHRIHTGEKPYECNDCGKTFSKTSHLRAHLRTRSGEKPYECSECGKTFSEKSYVSAHQRVHTGEKPYECNVCGKPFAHNSTLRVHQRIHTGEKSYECNDCGKTFSQKSHLSAHQRIHTGEKPYECNECGKAFAQNSTLRVHQRIHTGEKPYECDECGKTFVRKAALRVHHTRMHTREKTLACNGFGKS

SEQ ID NO: 781559 - protein, 726 aa, Homo sapiens; identical to SEQ ID NO: 781558

SEQ ID NO: 781560 - protein, 726 aa, Homo sapiens; identical to SEQ ID NO: 781558

SEQ ID NO: 781561 - protein, 30 aa, Homo sapiens
MSVPAPEQVDSVFLHLFALSRPSVDWMVPT

SEQ ID NO: 781562 - protein, 154 aa, Homo sapiens
DTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKEEVRAQN

SEQ ID NO: 781563 - protein, 791 aa, Homo sapiens
DTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEETVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 781564 - protein, 869 aa, Homo sapiens
DTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 781565 - protein, 804 aa, Homo sapiens
DTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 781566 - protein, 121 aa, Homo sapiens
HPTLTRALCTGQISHPLLPGEEGKGREGTHTGSSIPASPFSLTLAAPLLLVGGEGSPMSPRACGEAPPENQSLSLLLVFWSFHISLHPHSKHSLDHTVDWVQGLPWLPFVTGLAMGRKSNM

SEQ ID NO: 781567 - protein, 127 aa, Homo sapiens
MSIPSPTPQRPFLLMDPVSIYSLSVMCSILIILPQRPFLPMAPLSIYGVSSVCSVYSHLLPRIVFLTVDPVSTYAGPVVLGSTFFFLTPRRACSNHKASPKVLSCDKSRAEFIMITPFPLPSVPLGF

SEQ ID NO: 781568 - protein, 51 aa, Homo sapiens
VSSPSIQPQDALRSSVRLPRLGSSSVSRAALCPGEVGKVRRVTTVSRELCQ

SEQ ID NO: 781569 - protein, 142 aa, Homo sapiens
IFVPCRTLTVEQVTSSRTDGESPEAEALVNEIRNNQLQILKRRAKNQWPKLTASYPHFILLSFSPGHHVCRQRHPLGCHLEYHCSMAGCGHRMSDTDVPETNGHVFCSFPACGHWIGPPGSSTQPAWIPFRCKETSGGSLGT

SEQ ID NO: 781570 - protein, 118 aa, Homo sapiens
MRQLRWWLRSQCHQMAREQVESHRQGSPAAGRRRPPVTSTVSFVGGSHSMAGLSKPEHFPPSRACRGSIPSIGPAMDPSIPHCSYRTRISAATAVLVKNHLRPGAVAQIRNPSILGGR

SEQ ID NO: 781571 - protein, 87 aa, Homo sapiens
VLDVGRLTRFMLWSLTWLNVCPVLRDICLRMHWNLQIEEESLWETTILQHDMLTFRDIDMLHQAVYTVPLSFSSHPCLVEGIGNIIP

SEQ ID NO: 781572 - protein, 100 aa, Homo sapiens
LSCPHYPRKIQSSFQSILINPLDPKFREVPLPSSLLPGPTEEHPTTLHQLLKTHKGKIPTGPCQEVVELPSGSIKSYQKAECRNDIKRGSICRERVQDAK

SEQ ID NO: 781573 - protein, 177 aa, Homo sapiens
AVLEVPSGMQVSSREGVGELSVTDPGGGPEGLPGGVGESQALHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPY

SEQ ID NO: 781574 - protein, 49 aa, Homo sapiens
GGEVREVLFLALQGLYPFLSTGLLWPSPGAARGVEQGGCQWSHRQGKCG

SEQ ID NO: 781575 - protein, 147 aa, Homo sapiens
FSRSRTQVPHHHAPLTQASEGPGTPHHSPTAGELREAESLDSRERGPDLWISPASRSQCGSLWRQKLRLNPQATLNTEIQLRKKGADQGGMERPRHIMKTKKRKKDDAGAGAKGRGRGKEGKPGAETWQGSVSPTTTGWGWGAHQDF

SEQ ID NO: 781576 - protein, 147 aa, Homo sapiens; identical to SEQ ID NO: 781575

SEQ ID NO: 781577 - protein, 92 aa, Homo sapiens
LLVNFCLLFVYCVHRGRILPLLLEAASVLCCGGQEAGASRRQIHVCKRRRSVSLGVQRCLQVRLPTPPLCELGGGSAGTGGVHGEGFCVMKR

SEQ ID NO: 781578 - protein, 249 aa, Homo sapiens
MCCVSMNRFIPKEVADIFNAPSDDEEFVGFRDDVPMETLSSEESCDSFDSLESGKQQDVRFHSKYFTEELRRIFIEDTDSETEDLQDLLQSDLNGKTNPEVMVVESDLSDDGKASLVSEEEEDEEEDKATPEEAGLEEVVLVFEEPFSSPTKKLANKPDKNSSSEQCVLAHAYRMGKKHSGRTERLGPVIPRGESNSESRDEPRDENRRVRRLAKGPDLTEQGRLPDGGENEQFRRPTVEKRGAGKKRE

SEQ ID NO: 781579 - protein, 44 aa, Homo sapiens
MFGTFLASLLCPSESLGIELENSGHTRGLILAILRNLSLGQRLD

SEQ ID NO: 781580 - protein, 33 aa, Homo sapiens
MDGRAKGGGKAVKKEEEMNDDNAMKRISQRREK

SEQ ID NO: 781581 - protein, 63 aa, Homo sapiens
PWLGDGQPPCLLASPRLPRALQQGEGPRLGVSWAGPPDAQGLEVLASMQLARSSFLPGKAAQR

SEQ ID NO: 781582 - protein, 104 aa, Homo sapiens
PPTQGTPDLQQPLLTHTPIPWRVSRLFPATPTKHHSLCIRMGPVLRLTPASLTSLLQWPTNFSFSFSFLRWSLAVSPRLHLRRKKIHTRTHTHTHLESQRVRAY

SEQ ID NO: 781583 - protein, 32 aa, Homo sapiens
MVVSAGPWSSEKAEMNILEINEKLRPQLAENK

SEQ ID NO: 781584 - protein, 102 aa, Homo sapiens
WREGGGGRVGQRPRSACDTLRGCKAPERPSELGTSHRVPGRAGEGGPPKRQDPLSERRKEREEEGGKEGRMMRLEKETAPGPSREGLPHKVRGVPSGHRHHT

SEQ ID NO: 781585 - protein, 46 aa, Homo sapiens
MCSEMRDLHPRPCWRSAPCGEVELSVPEGCGQGCISLVAEVSGLHA

SEQ ID NO: 781586 - protein, 196 aa, Homo sapiens
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGNGATLYWITFPTKGIDFRRIYQWHGKRSGSPGDCLQELRLLQCAESNL

SEQ ID NO: 781587 - protein, 161 aa, Homo sapiens
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGNGATLYWITFPTK

SEQ ID NO: 781588 - protein, 209 aa, Homo sapiens
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGELTLEEFINGMAKDQDLLEIVYKSFDFSNVLRVICNGKQPDMETDSSKSPDKAGLGKVKMK

SEQ ID NO: 781589 - protein, 158 aa, Homo sapiens [sequence omitted]

SEQ ID NO: 781590 - protein, 263 aa, Homo sapiens
ERRKGGRRKKLFQKSIGCLEECGRPLGKVHIWEKQAAPRSHSRSSARPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQCADSWKNN

SEQ ID NO: 781591 - protein, 154 aa, Homo sapiens
MAILVDRLHRRDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQCADSWKNN

SEQ ID NO: 781592 - protein, 82 aa, Homo sapiens
STTTKFAAASTYSQKEDRYEEEIKVLSDKLKEAETRAEFAERSVTKLEKSIDDLEDELYAQKLKYKAISEELDHALNDMTSI

SEQ ID NO: 781593 - protein, 226 aa, Homo sapiens
AVRPGIMGSRPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQCADSWKNN

SEQ ID NO: 781594 - protein, 290 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQCADSWKNN

SEQ ID NO: 781595 - protein, 226 aa, Homo sapiens
AVRPGIMGSRPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCADSLKKN

SEQ ID NO: 781596 - protein, 290 aa, Homo sapiens; identical to SEQ ID NO: 781594

SEQ ID NO: 781597 - protein, 290 aa, Homo sapiens; identical to SEQ ID NO: 781594

SEQ ID NO: 781598 - protein, 290 aa, Homo sapiens; identical to SEQ ID NO: 781594

SEQ ID NO: 781599 - protein, 257 aa, Homo sapiens
AVRPGIMGSRPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGVSGPGARRPRMGCCRAVTKQHDLLAAAHYLFQLRAPFVLI

SEQ ID NO: 781600 - protein, 397 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEEDIAAKEKLLRVSEDERDRVLEELHKAEDSLLAAEEAAAKVPGARGTAWRTNGYLFLFLSLPPCLSLCLSRCPCPSGSVHPHPSPSGSRCLLHPPPSLYPLANSQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCADSLKKN

SEQ ID NO: 781601 - protein, 226 aa, Homo sapiens; identical to SEQ ID NO: 781595

SEQ ID NO: 781602 - protein, 290 aa, Homo sapiens; identical to SEQ ID NO: 781594

SEQ ID NO: 781603 - protein, 290 aa, Homo sapiens; identical to SEQ ID NO: 781594

SEQ ID NO: 781604 - protein, 290 aa, Homo sapiens; identical to SEQ ID NO: 781594

SEQ ID NO: 781605 - protein, 226 aa, Homo sapiens; identical to SEQ ID NO: 781595

SEQ ID NO: 781606 - protein, 186 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEEDIAAKEKLLRVSEDERDRVLEELHKAEDSLLAAEEAAAKVPGARGTAWRTNG

SEQ ID NO: 781607 - protein, 226 aa, Homo sapiens; identical to SEQ ID NO: 781595

SEQ ID NO: 781608 - protein, 226 aa, Homo sapiens; identical to SEQ ID NO: 781595

SEQ ID NO: 781609 - protein, 290 aa, Homo sapiens; identical to SEQ ID NO: 781594

SEQ ID NO: 781610 - protein, 226 aa, Homo sapiens; identical to SEQ ID NO: 781595

SEQ ID NO: 781611 - protein, 226 aa, Homo sapiens; identical to SEQ ID NO: 781595

SEQ ID NO: 781612 - protein, 290 aa, Homo sapiens; identical to SEQ ID NO: 781594

SEQ ID NO: 781613 - protein, 225 aa, Homo sapiens
AVRPGIMGSRPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKSSQLEED

SEQ ID NO: 781614 - protein, 277 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDQMCRQLEEELKNNCDQNNLKVTGWLQS

SEQ ID NO: 781615 - protein, 238 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDLCICLFSS

SEQ ID NO: 781616 - protein, 218 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESER

SEQ ID NO: 781617 - protein, 189 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQVCASPALRPRPERRDSSLAPPAGSPPRGLGEPPPYPHHHPGRPGRASGKKEGKRKSQA

SEQ ID NO: 781618 - protein, 66 aa, Homo sapiens
FLQGVEEQLGSSNSENPGVRAGQVQHPLLEKPNDALYKSRMHTSPKTPSSSWMSHLSELCICLFSS

SEQ ID NO: 781619 - protein, 263 aa, Homo sapiens
ERRKGGRRKKLFQKSIGCLEECGRPLGKVHIWEKQAAPRSHSRSSARPRARPAAPAAAPGPLAAATMDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCADSLKKN

SEQ ID NO: 781620 - protein, 116 aa, Homo sapiens
MLFTLYLAEADVASLNRRIQLVEEELDRAQERLATALQKLEEAEKAADESERGMKVIESRAQKDEEKMEIQEIQLKEAKHIAEDADRKYEEVRSWGPKPCGHPAVAFRKPGSNVQS

SEQ ID NO: 781621 - protein, 138 aa, Homo sapiens
MTNTKGKRRGTRYMFSRPFRKHGVVPLATYMRIYKKGDIVDIKGMGTVQKGMPHKCYHGKTGRVYNVTQHAVGIVVNKQVKGKILAKRINVRIEHIKHSKSRDSFLKRVKENDRKRKKPKRKVPELSEGKCADSLKKN

SEQ ID NO: 781622 - protein, 290 aa, Homo sapiens; identical to SEQ ID NO: 781594

SEQ ID NO: 781623 - protein, 397 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEEDIAAKEKLLRVSEDERDRVLEELHKAEDSLLAAEEAAAKVPGARGTAWRTNGYLFLFLSLPPCLSLCLSRCPCPSGSVHPHPSPSGSRCLLHPPPSLYPLANSQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQCADSWKNN

SEQ ID NO: 781624 - protein, 290 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQCADSWKNN

SEQ ID NO: 781625 - protein, 226 aa, Homo sapiens; identical to SEQ ID NO: 781595

SEQ ID NO: 781626 - protein, 290 aa, Homo sapiens; identical to SEQ ID NO: 781594

SEQ ID NO: 781627 - protein, 290 aa, Homo sapiens; identical to SEQ ID NO: 781594

SEQ ID NO: 781628 - protein, 290 aa, Homo sapiens; identical to SEQ ID NO: 781594

SEQ ID NO: 781629 - protein, 290 aa, Homo sapiens; identical to SEQ ID NO: 781594

SEQ ID NO: 781630 - protein, 290 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEEDIAAKEKLLRVSEDERDRVLEELHKAEDSLLAAEEAAAKAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCADSLKKN

SEQ ID NO: 781631 - protein, 277 aa, Homo sapiens; identical to SEQ ID NO: 781614

SEQ ID NO: 781632 - protein, 290 aa, Homo sapiens; identical to SEQ ID NO: 781594

SEQ ID NO: 781633 - protein, 226 aa, Homo sapiens; identical to SEQ ID NO: 781595

SEQ ID NO: 781634 - protein, 290 aa, Homo sapiens; identical to SEQ ID NO: 781594

SEQ ID NO: 781635 - protein, 290 aa, Homo sapiens; identical to SEQ ID NO: 781594

SEQ ID NO: 781636 - protein, 226 aa, Homo sapiens; identical to SEQ ID NO: 781595

SEQ ID NO: 781637 - protein, 226 aa, Homo sapiens; identical to SEQ ID NO: 781595

SEQ ID NO: 781638 - protein, 290 aa, Homo sapiens; identical to SEQ ID NO: 781594

SEQ ID NO: 781639 - protein, 226 aa, Homo sapiens; identical to SEQ ID NO: 781595

SEQ ID NO: 781640 - protein, 290 aa, Homo sapiens; identical to SEQ ID NO: 781594

SEQ ID NO: 781641 - protein, 290 aa, Homo sapiens; identical to SEQ ID NO: 781594

SEQ ID NO: 781642 - protein, 264 aa, Homo sapiens
AVRPGIMGSRPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGGKCAETSGTALLEELHKAEDSLLAAEEAAAKLKRRASLQSIQLVEES

SEQ ID NO: 781643 - protein, 242 aa, Homo sapiens
ESPAVFVPQEVSGTPFPVIVIFIQTSGGSIRFLTDIREASFKRENRIDKQGFMSGSLSLCVTEGISNSLLTTARPRARPAAPAAAPGPLAAATMDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDCAELERLNCTTP

SEQ ID NO: 781644 - protein, 186 aa, Homo sapiens; identical to SEQ ID NO: 781606

SEQ ID NO: 781645 - protein, 118 aa, Homo sapiens [sequence omitted]

SEQ ID NO: 781646 - protein, 54 aa, Homo sapiens
IVPLCDEVENIGHNSILMLEGDRCEFSSHPCDASGTSVGEEHLPSSREPESLSL

SEQ ID NO: 781647 - protein, 43 aa, Homo sapiens
CRLQPHKAEDEEEGWSGASWGRPCMPGYWLLERYPESLGMEWN

SEQ ID NO: 781648 - protein, 70 aa, Homo sapiens
GPAVEARWGRFGRQKQEGRRKLGAHEPLCAGARPTSSKQKGWAPSVVPWALGKARGNTSSSPAFITNAKH

SEQ ID NO: 781649 - protein, 94 aa, Homo sapiens
LNLLPQVAQATSELCQVSIKTQQQIKKAIINAAASQAPRKVSRVRVVSSLQSSVVETFNKVLSSVNPVHLHPKPQSSCQCRDHITDALVQVLGV

SEQ ID NO: 781650 - protein, 56 aa, Homo sapiens
AAAYYYYYCSEFKLLTMYGDHATALHLGDRETPSKKKERGKKERTNERKKRKNPYL

SEQ ID NO: 781651 - protein, 91 aa, Homo sapiens
QDGAGGHWGEHEQKLPKDHRRLQLLVFISRPRVPITGSCPLKHSKHIARHTPACSPGVLPPVPGGPLLTSQPSLVSGTPCPDPGPVPLCVT

SEQ ID NO: 781652 - protein, 74 aa, Homo sapiens
LGPIADEVTGGTKKMPTPTATRDPHQHLGCRGSMALCRRCPSLARSLHPSLDSLTPRGFPARCEEGEEATPQPG

SEQ ID NO: 781653 - protein, 113 aa, Homo sapiens
SRHTCPLFNGLGMLRDLFLQFSIPHPRLFILSSGAWHLCSGPTPLLFYSLFSAFSTPILTLTLLYPHSAHFCLWQSPRPIVSWASYPAPAPASGPLSSSSLEAVSSEKSSLTP

SEQ ID NO: 781654 - protein, 92 aa, Homo sapiens
QPNPSGIFYLIQKYVFLNVRNTAQHELTGKVGLVLPAGIFWALLDGCTILLGLIPHTAHPPEHLHTLDFLCCLSMSVVCRENVPFSQGPDSS

SEQ ID NO: 781655 - protein, 41 aa, Homo sapiens
MALEEFCQMGQGKLPPLHNLAGLLKQLEAVLSLSLQEVEVL

SEQ ID NO: 781656 - protein, 213 aa, Homo sapiens
SSLKPFSFLEKEEQLKEAARQRDLAATAEAKISKQKATRRIPKSILEPALGDKLQEAELFRKIRIQMRALDMLQMASSPIASSSNRANPQPRTATRTQQEKLGFLHTNFRFQPRVNPVVPDYEGLYKAFQRRAAKRRETQEATRNKPFLLRTANLRHPQRPCDAATTGRRQDSPQPPATPLPRSRSLSGLASLSANTLPVHITDATRKRESAV

SEQ ID NO: 781657 - protein, 39 aa, Homo sapiens
MEPKALPREKEELGSAHFSRVLKMSCKKVTQPGWRYRPN

SEQ ID NO: 781658 - protein, 85 aa, Homo sapiens
REGYAASSSLMTMSGTLEHHLLPGRVKGMWNHSLTPACFSSEVARISSTRISLAKADYTAGPNPKWKKCSPSLFPEEETGTDGQG

SEQ ID NO: 781659 - protein, 114 aa, Homo sapiens
MGVWSELEVWPKSVGAWPGRLVLDKPLDGSATNMFPALEPSFSSVSGLVCPLPSSISFFPSMCSALICILGTLPHVNSNCTPPFLTAPPSGHLAHLHPHCPLNSEQLQPQRTSA

SEQ ID NO: 781660 - protein, 107 aa, Homo sapiens
KRHLPAVEECSIRLKNRFWEIPGCKEAQKLPWGAQMSSKRVGHRLSLKGVSRTGEVHGAGIPNRTQDLSRGLPETGEHTRLAGASFGYGESLVRRADQGWIMGGTEW

SEQ ID NO: 781661 - protein, 38 aa, Homo sapiens
RLSLPAAASGDPVKGKTYSKYELELWGTGGSTLPFPVL

SEQ ID NO: 781662 - protein, 102 aa, Homo sapiens
VNVLTVATPKLDVTPHRENIVIDVSANDSDTLLHLEMMVKTTSYHYIPVTLTHASKYLDKTGDGEVSFEEFQVLVKKISQCRRKQNRTLSTGGRAPVLCSYH

SEQ ID NO: 781663 - protein, 145 aa, Homo sapiens [sequence omitted]

SEQ ID NO: 781664 - protein, 69 aa, Homo sapiens
MIQAEEREVQASIHGICPISSEKTKRGQIQRVGGLAMQDTGKARLKDPGHREIKGPKQAAASPQTKDSP

SEQ ID NO: 781665 - protein, 102 aa, Homo sapiens
PDGTEKGGHCRRREARGPRCGAKPVVGLALGLGARAAGGGQESLLTTVQAETFQQQGPAGKHEEVRGVAPGLKTEKRLGAVAHACDLSTLGGRGRRVMRSGD

SEQ ID NO: 781666 - protein, 475 aa, Homo sapiens
MEFVTALADLRAEASCPICLDYLKDPVTISCGHNFCLSCIIMSWKDLHDSFPCPFCHFCCPERKFISNPQLGSLTEIAKQLQIRSKKRKRQEEKHVCKKHNQVLTFFCQKDLELLCPRCSLSTDHQHHCVWPIKKAASYHRKKLEEYNAPWKERVELIEKVITMQTRKSLELKKKVKHRAEEVKSEFEQLRLFLQNEQETVLRQLQDEEMDILAQLNESLTKFSDYTSSLKYLLKEIESIYVKSELELLANVKDIYHRYKNLKFPELFLFKLKKYGYHLPPQYSGLDKIIKRFQVDVILDPETAHRKLIVSEDRKTVRYGNTTQNVPHNPRRFYLLPAVLGSKGYSCGRQYWEVEVKDKPEWILGVCNDCLPRRRKSQPILVQDGLWGIWRSSQNNYIVLGHKEIILLPQVIPSKIGIFLDYEMNEVSFYNLNDRSLLYTFNDNFTGALWPYFYTGTDSKPLKISTVTDSEFSFT

SEQ ID NO: 781667 - protein, 430 aa, Homo sapiens [sequence omitted]

SEQ ID NO: 781668 - protein, 430 aa, Homo sapiens [sequence omitted]

SEQ ID NO: 781669 - protein, 39 aa, Homo sapiens
LAAGSLQHGASLQPRLRLGSRQCLGGHGALGVWPRKVGP

SEQ ID NO: 781670 - protein, 115 aa, Homo sapiens
SFLCHMWTKKGESPFPLLRPDSCNSEHSSGSNTPLVKRLSQSSCPRKPNGNRLCSRPGLFHSHSRACQRDRHKKAGPDQLKRSGPGLNMDDSITRNRSLLRVYQLGYLPHGFSKP

SEQ ID NO: 781671 - protein, 35 aa, Homo sapiens
QLKNFLTQPGMVAHTCNPNTSERSRRADLLSSGIQ

SEQ ID NO: 781672 - protein, 73 aa, Homo sapiens
LARIDLNEALTQPVYDQIDPVFGSIFRTGKPTGSALMPHIDAFKQSQENRLNPGGIGCSEPRSRHCTPAWTTE

SEQ ID NO: 781673 - protein, 199 aa, Homo sapiens
AGGETCAAEGEAEPAPAAQRSRSRRRHLGWEPTRLPHPALGTMGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTTQNNKCFTEHISDINIHNDRNPQIVQVTSAASSVTITTNYAF

SEQ ID NO: 781674 - protein, 190 aa, Homo sapiens
AWRRPRCNFLRSSRIRVHPTPAASTMPPKFDPNEIKVVYLRCTGGEVGATSALAPKIGPLGLSPKKVGDDIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 781675 - protein, 125 aa, Homo sapiens
SGMSVKGVNELGMNEGCCFWPALSQRLTLAAALSPPAWQDHPGCSASHRGLTSQIRRLRPIMGSCPPSRDLLEAGVQASRASHQPASPATWKEASNDTIEQQQQNSSSTLTFIVHFHINCRMQAQ

SEQ ID NO: 781676 - protein, 79 aa, Homo sapiens
TSPRVVLLAKWTSDKVLFRDFFDCVSKANISPARQPSAHTEHLTASTTSIPSVVCWARTAWVTAAPFYFYRVSNQPTVD

SEQ ID NO: 781677 - protein, 102 aa, Homo sapiens
PPDGVLTLPPVDGLPGRPPCPPGAESGPQTKFCSEISLIVSPRRISVQLDSHQPTQSISQPPPPPSLLWSAGQGQPGSQPPHSISTEFQTSQPWTSSQPWTS

SEQ ID NO: 781678 - protein, 61 aa, Homo sapiens
GFPRPGRSVGQTTQQLVKSKGASRARWLTPVIPALWEAEAGRSRGQEIETILANRVKPRLY

SEQ ID NO: 781679 - protein, 59 aa, Homo sapiens
EVRTASVILWPVRAAGAPCRADRAEDRTCRFLITGQKRGPEQRVTSPEPTRTHRQKLLG

SEQ ID NO: 781680 - protein, 93 aa, Homo sapiens
VQSQVTVASNSWAQPVLLPQPLEWLGLMHHYAWLIVWGARGVEMGSHCIDYTGLELASSHHAIWLRPLNVLALQVGAIVPSPLSVFIKEQKLD

SEQ ID NO: 781681 - protein, 45 aa, Homo sapiens
AAAYYYYCSNSSFYDVRGHAVILKKCYYRSSTNTLGKFRKYSLEK

SEQ ID NO: 781682 - protein, 103 aa, Homo sapiens
CGFWCVVNSSTEAGCNKPILISKFGRSLKFFPHAPLIRPPGQVHGTEGLYGLVQACFFVVVVEKREFCHVGQAGLELLAYLKWTARLGLPKCWDYRYEPLCLA

SEQ ID NO: 781683 - protein, 43 aa, Homo sapiens
GELVLACCHFHCIKDHFGDSEPCQLIDMDTVNSSGMEPENVGH

SEQ ID NO: 781684 - protein, 50 aa, Homo sapiens
PAEKAAKGGRDGGGPECRPRFNPGASPPRKVLGRKGELIVPLKHSVDPRG

SEQ ID NO: 781685 - protein, 106 aa, Homo sapiens
SCTPGLKTSLGRESFGPPTKQHWHYASHPRPWLHVVKQPLLVIHSQLSSFPQMALWGAGACLFLRLKTISFPRVSPLMLFSFDQACLNSREVRRNTPILGLKGLMF

SEQ ID NO: 781686 - protein, 122 aa, Homo sapiens
AVLEDTFPFNPARRARNNGFTRTCSQAEQHSTHEEVVYLQISEERCREKHTAPEDQCAWRPLGHTARCQELQLTSTMACLLAGQPYKILLLFTHNNNNCSENKTQNRQNHWNTKTRLLQVLF

SEQ ID NO: 781687 - protein, 118 aa, Homo sapiens [sequence omitted]

SEQ ID NO: 781688 - protein, 105 aa, Homo sapiens
SPTPDLVVRLGFPKCWDYRRESPSPAFSISLIAYLLMMNSLSFDLNTSSFLKTIFTRLELSGFSSTSALKNAHMLSSSFHSPTQKSAVSLFLALLKDIKSFFLSV

SEQ ID NO: 781689 - protein, 82 aa, Homo sapiens
MAAGRLLLYTGLSLALCALGMLAVAICSDHWYETDARKHRDRCKAFNTRRVDPGFIYNNNNNLPLRASRSRLDRWEGKLLRA

SEQ ID NO: 781690 - protein, 155 aa, Homo sapiens
KRCSQRPLPLSSPIPKRRRKCLYGQAASPIHQESQELSDSPETLCALRKDSTLRLGKRCQVFSCGSWQLAGHCDSPGCPLEMAPGFLHALQRKAVWREIWKLVPTPVSAKALGRPCTDKLALPGSRRYCLQVVQTGTDLSRSDLRNALFVYRTPS

SEQ ID NO: 781691 - protein, 118 aa, Homo sapiens
RHKLLISEMKEGPITTDPINIKRIINIRNTSMLTNLIRDEMDQFLEGHNLLKPIRKETHHLSVACIYLKIESIISNFSKRKAPGLDGGSLVNSTKHLRKKRYWLGAVAHTCNLSTLGS

SEQ ID NO: 781692 - protein, 201 aa, Homo sapiens
RFETSRGSRGGRRERGLGPCACENGSFEVETGERTLSQVPWEKAGPGRELQGARLGRGWAEILRAGSGGGSGRGLQRGEGSMGGRRLLGGLLARTPPGVRCGGQPSALSPQPQLLRGLHSPSLPRLRGFSLALFPLRPLLKAPEMLKSGLLVPGLLSMNFLQTPGFQLPPFCPFTGKGDCNSGLFPIPVLPDQPRFESRAE

SEQ ID NO: 781693 - protein, 166 aa, Homo sapiens
MFVKSETLELKEEEDVLVLLGSASPALAALTPLSSSADEEEEEEPGASGGARRQARGLRPGKGARGGVGCGVRRAAGPQRLLGLVHDLHNCPSRARAVSRGAKTAETVQRIKKTRRLKANNRERNRMHNLNAALDALREVLPTFPEDAKLTKIETLLSPTTTSGHS

SEQ ID NO: 781694 - protein, 166 aa, Homo sapiens; identical to SEQ ID NO: 781693

SEQ ID NO: 781695 - protein, 161 aa, Homo sapiens
CCCCFQIVPVLRMFLAPCSIHLLNTVKVSSMSFHRTLELASCLPEGSGLNPKVNGTREEKGGDAKWTPSSKPLLPEGLQAAARSRSSNSAERLALWRASRSIAGIAVWSHLTKKSATIFRNQELYYIWTHNKGSPGSFSFVCCKPNLFPRSALLFLHSLSQ

SEQ ID NO: 781696 - protein, 76 aa, Homo sapiens
DGNTGGTYEAIFRIRPGRVEQTGQEREPWPNGAGGSSTAAGDPSGSQQCNRGKSFHTFSLTLNKSYWVLGVHLLLF

SEQ ID NO: 781697 - protein, 137 aa, Homo sapiens
NEEVVGAAVPRGTGLGAGEEKRDGNREMDGQHPHHGEDSGQHLHLASLINKAKGWDWPGGRGGKRDGNREVLGFLAKETRRHPWLFMARLPAAFRHLGPSVTVIGHSGSSVPKRPCLLLLSWVSPGNAQGPRGWPAL

SEQ ID NO: 781698 - protein, 344 aa, Homo sapiens
RGRGALGGRSGSAAGAAAGTAALHHRIMSGQLERCEREWHELEGEFQELQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNTWISQWFWQLYNAVTLFELSSHEECREWQVFVLAFTFLILFLGNFLTTLKVVHAKLQKNRGKTKQP

SEQ ID NO: 781699 - protein, 366 aa, Homo sapiens
RGRGALGGRSGSAAGAAAGTAALHHRIMSGQLERCEREWHELEGEFQELQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNHLDLTVEGFQSWMWRGLTFLLPFLFCGHFWQLYNAVTLFELSSHEECREWQVFVLAFTFLILFLGNFLTTLKVVHAKLQKNRGKTKQP

SEQ ID NO: 781700 - protein, 33 aa, Homo sapiens
IHRFVLWASGADAPGQKNEFLQDGPVNGSLVEN

SEQ ID NO: 781701 - protein, 34 aa, Homo sapiens
MPDLLDLLCGITPRILIRTRACAYTPTHTHTCSH

SEQ ID NO: 781702 - protein, 132 aa, Homo sapiens
SAHCNLRIPGSSDSPASASRVAGITGTYNRRQSINDHVMGAPSMMKGMNEYLLWHGGRWRWREHLKVEEIGTCLPLVTESGTGARFCLLREANCQSRTKASHPAGPSSLFLRESKDCGTRPAGLLVFSHLCL

SEQ ID NO: 781703 - protein, 321 aa, Homo sapiens
MKHIPVLEDGPWKTVCVKELNGLKKLKRKGKEPARRANGYKTFRLDLEAPEPRAVATNGLRDRTHRLQPVPVPVPVPVPVAPAVPPRGGTDTAGERGGSRAPEVSDARKRCFALGAVGPGLPTPPPPPPPAPQSQAPGGPEAQPFREPGLRPRILLCAPPARPAPSAPPAPPAPPESTVRPAPPTRPGESSYSSISHVIYNNHQDSSASPRKRPGEATAASSEIKALQQTRRLLANARERTRVHTISAAFEALRKQVPCYSYGQKLSKLAILRIACNYILSLARLADLDYSADHSNLSFSECVQRCTRTLQAEGRAKKRKE

SEQ ID NO: 781704 - protein, 133 aa, Homo sapiens
MSDWLQARPRPPLWALLPVRPEDKVSSLSPASWSSPRCRQMPSLQPLRVGSEHACLPLPSALTQPIRGCFALCPLPGGEGRAQPPTHSDPKAHCPAAEIRCQRLDRDTEGNGVVKPHSEKPHRCSVTFAPPVA

SEQ ID NO: 781705 - protein, 321 aa, Homo sapiens; identical to SEQ ID NO: 781703

SEQ ID NO: 781706 - protein, 321 aa, Homo sapiens; identical to SEQ ID NO: 781703

SEQ ID NO: 781707 - protein, 87 aa, Homo sapiens
SHVIYNNHQDSSASPRKRPGEATAASSEIKALQQTRRLLANARERTRVHTISAAFEALRKQVPARRRTPSLRRGTTAGMGGRVAGAG

SEQ ID NO: 781708 - protein, 104 aa, Homo sapiens
DTQVLHQRCCCVGRNLHMHRRPRACFPFNTQSHPSTHTHSHTEPCHSLSYTHLLTVHIKMTMHWSGCAHTHSHHRQEDKAHSPPYTHSHTCRSWWVIHLPPKVT

SEQ ID NO: 781709 - protein, 45 aa, Homo sapiens
MAEAAENSHPCLKCSLKIDCNKWSQNNSPSPAAGALWARSLTASP

SEQ ID NO: 781710 - protein, 93 aa, Homo sapiens
IKRDDWLGTHSGWDDPGNHAQGEKPGEPVPTEYPEWEDPDTESHSTVARGWGGGKQGATEEQARTGFPLGTHGVSKAAEYAKSHPLKHTELVL

SEQ ID NO: 781711 - protein, 112 aa, Homo sapiens
KLVGKASNTHILTTHTGGSEKKNKYKWLRDMRSVALTFAERDPININPHLWVREGWHSRACLEALPTGTKRTAWKAILGQVWWLKPVIPALWEAEAGGSPEVRSSRQAWPTW

SEQ ID NO: 781712 - protein, 75 aa, Homo sapiens
MVAFGASPGFWLCVAPMIQSCLEPPPSLAEILPVLLAKYLGHSTSPASCPLPPALDLVPSLLPKAYLSHKVGIAY

SEQ ID NO: 781713 - protein, 36 aa, Homo sapiens
MAPTFTDGWMDKQMWHLYPQTDKQTWHLHPRTDGQI

SEQ ID NO: 781714 - protein, 181 aa, Homo sapiens
MNDPFARMETRGPQGAANPMDSSRSLGDLGPFPREVGRGAPLAPGARNPATAGASRSQGGGHEDRTADRALGPRAGEELDRESWVREKVLFLLHPERWLGTRGDPAREEVAGAEDLPHAGGEDHGEEPNYPSVFQRQKRISGRRVAPPRDAADPPKYVLVRVEDYQVTQEVLQTSWAKGRM

SEQ ID NO: 781715 - protein, 141 aa, Homo sapiens
QCLLSSHSNYYQCLLQNEVIGLQSWLSRRFCGLSQLSRCCRCCVSMAARMKRNRRSNLKSQQVGGRVKSRSSRFSELSGEHAFSTTTHHNGTAYELLGNYLNNKENDLCLESFIICHRRHEISSLGKVFAPFCNLSKTLML

SEQ ID NO: 781716 - protein, 70 aa, Homo sapiens
MQYREGTDLSPPVLPRQHHHQCNHIHSRQQQEFSREQQEFSREQQEFSREQQEFSREQQEFSREQQEFSR

SEQ ID NO: 781717 - protein, 39 aa, Homo sapiens
MWVNCHNGGIHSMWALCQGQGGTAVNKPDVGPALGHHQS

SEQ ID NO: 781718 - protein, 114 aa, Homo sapiens
PNLVPLRILNLLCNHPKLLPATVWQRSCYSRYLEEGAHLHPCRQACRSGPLLGSLRQFNDSVSVTRATVYGQFSLYRNPHSYLRKCSLVLTESHTHQHPDTRSTICRPNCKNLP

SEQ ID NO: 781719 - protein, 252 aa, Homo sapiens
GGWVGYLARPGASAGHQSRRSSSSSSRLASRASSAPPGRILSHRRRRHRCCRGEAQPGRPRLAAPAAAATAAVAAAPRTHSVHRRQRGAPAAHPAESPRRAEKKPRSGSPRAPGPGPRSAAIGWQMTIRRARRLSSRRRSELLRAPVAAATAAAAAAARGHLKVGARKLNSVLIGLQVFCALASSRVPANPPDAHADHPATPQLCLRREERRKRGRFKNFQNCAVAWLDPPTHEESWGLGNCWVDHDTEQKQ

SEQ ID NO: 781720 - protein, 121 aa, Homo sapiens
PPLFVAKPSHAVPFLRRPPHPGSAGLRGCHRLGNRPPVGGESRDARKCSEACRPAARSASVSGSVTEVAPVRPFHPSSLHRPPILSRAASGPDSACGLSSIVPTLAPLGPSGQPWDSADAS

SEQ ID NO: 781721 - protein, 115 aa, Homo sapiens
PPCFHYLPSEQIHPVYSTCLSSRSTLSTLPACPANPLCLHYLAVQQIHPVYTTCLSSRSTLSILPACLADPPCLYYLPIQQVHPVYTTSLPSRSTLSTLPAWPEDPPCLHYLPCQ

SEQ ID NO: 781722 - protein, 41 aa, Homo sapiens
SCHVEHIHFQSVDPFYPFVTPTRHEMNQKDFPPIKITALCL

SEQ ID NO: 781723 - protein, 76 aa, Homo sapiens
EPPEEERSDGGAPQSRRRVVWPCYDSCPWSHLSGGTTGRRQESGDLSNGGESIAVELKDKWGKRGKREKGRDSSQR

SEQ ID NO: 781724 - protein, 264 aa, Homo sapiens
ERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHS

SEQ ID NO: 781725 - protein, 199 aa, Homo sapiens
ERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRITRSRGITRSRGITRSRGITRSRGITRSRG

SEQ ID NO: 781726 - protein, 97 aa, Homo sapiens
ERDAGDKTPGAVNDGRSHRAPQSGPPLPSSGNEQHSSASIFEHVDRISRPPEASRRVPSKIQLIAMQPIPAPPVQRPSPADRVAESNKINKEVFAFI

SEQ ID NO: 781727 - protein, 76 aa, Homo sapiens
PSHLSFLGSWDPRPSIPCEEGSGHGFLDAVSSAVTLLRGAATIPPSSLRAPNPCPCPVSEHSAGLCQALSSTLQPW

SEQ ID NO: 781728 - protein, 40 aa, Homo sapiens
VSIDSHQHMTHLPTSGPTDPLSLMLPEMDPELLAKANPST

SEQ ID NO: 781729 - protein, 195 aa, Homo sapiens
FISTLLKKRIRMQGFIIFDDYGSQYPEFYQQMSEWLKDGKIKYKEHMVQGLDNTINAFNGMLKGENFGKVVVKIKKIGIIMITLHHLDQSRSFRILWLLEEIKQPYELKRYYRDSSTHLAPDSLKTIHPLGKSPVLEWDGKVIAESGAIVELLIQKLAPHLAPDMDESTYVDYLQWIHFSESSAMLPFLLKTFNT

SEQ ID NO: 781730 - protein, 30 aa, Homo sapiens
MSGEAGLSEDAGAAGPGLLRRALPRGSDRP

SEQ ID NO: 781731 - protein, 42 aa, Homo sapiens
SYISASFMHFALSVCFTFWLSEPDLQVSLQFPSASAHWAAPT

SEQ ID NO: 781732 - protein, 53 aa, Homo sapiens
MNAAPSPRDHSVPVKVLFVRSKTEIQQSSQKTQINGRHLPQTPTQEREYGLMS

SEQ ID NO: 781733 - protein, 53 aa, Homo sapiens; identical to SEQ ID NO: 781732

SEQ ID NO: 781734 - protein, 50 aa, Homo sapiens
KVENVWHVWEEEEKRTSGRYLENPSPGGRPLGLDPTCANFLLVLGPTSCL

SEQ ID NO: 781735 - protein, 34 aa, Homo sapiens
QQHADPPLFPAAQATYSECACLALGGAPAPALQA

SEQ ID NO: 781736 - protein, 70 aa, Homo sapiens
ESTSAVLSGFVLAALAFQHLNTDSDTEGFLLGEVKGEAKNSITDSQMDDVEVVYTIDGVSFCRPDWSEVA

SEQ ID NO: 781737 - protein, 70 aa, Homo sapiens
LTSSRLAARSPGRPGKPFHTRPSRSRDFLWLQSSLTIFWEVMDHHIPMHALPEEIQKNLRCRHAVKKSTK

SEQ ID NO: 781738 - protein, 103 aa, Homo sapiens
SLYLLNLILFNSKPVSLPATEPSMFSLVLGRTVLRPYIILRKARSGLRMSHLLITPMAAPALTSHRVSPYLGMLLCLSRSRSINTCFMNECMNKGKLVTCKGG

SEQ ID NO: 781739 - protein, 164 aa, Homo sapiens
LTSSRLAARSPGRPGKPFHTRPSRSRDFLWLQSSLTIFWEVMDHHIPMHALPEEIQKMLPEEKVCKYCGVSYLILHEFKAMEEKVKAMEKEMKFYQGSVDREKRLQEKLHSLSQELEQYKIDNKSKTESKIYFRLMLRLEVEHCQLKERMPDLQHSVTEPYIGL

SEQ ID NO: 781740 - protein, 199 aa, Homo sapiens
LTSSRLAARSPGRPGKPFHTRPSRSRGEGRWLSSAWDDPVLQMQFRSGGVLAPGERARKLSRGAPARARGPGSGLRHHAPLRPLPGVCQPAGPRRGPPSSQPRGTRGSASSPPHPPPPPLPATAGPGGTGLERDRFESHSSSFVWPCGWFLCGRACRFRKVLGCELPPSPAPDLLVVGDSRHGNGSLRKGLKAERELMA

SEQ ID NO: 781741 - protein, 341 aa, Homo sapiens
LTSSRLAARSPGRPGKPFHTRPSRSRGEGRWLSSAWDDPVLQMQFRSGGVLAPGERARKLSRGAPARARGPGSGLRHHAPLRPLPGVCQPAGPRRGPPSSQPRGTRGSASSPPHPPPPPLPATAGPGGTGLERDRFESHSSSFVWPCGWFLCGRACRFRKVLGCELPPSPAPDLLVVGDSRHGNGSLRKGLKAEHFLWLQSSLTIFWEVMDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFRLCFC

SEQ ID NO: 781742 - protein, 173 aa, Homo sapiens
LTSSRLAARSPGRPGKPFHTRPSRSRDFLWLQSSLTIFWEVMDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFRLCFC

SEQ ID NO: 781743 - protein, 151 aa, Homo sapiens
LTSSRLAARSPGRPGKPFHTRPSRSRDFLWLQSSLTIFWEVMDHHIPMHALPEEIQKMLPEEKVCKYCGVSYLILHEFKAMEEKVKAMEKEMKFYQGSVDREKRLQEKLHSLSQELEQYKIDNKSKTERLSMFFFSIIYLVERQLQEINTL

SEQ ID NO: 781744 - protein, 199 aa, Homo sapiens; identical to SEQ ID NO: 781740

SEQ ID NO: 781745 - protein, 218 aa, Homo sapiens
SLYLLNLILFNSKPVSLPATEPSMFSLVLGRTVLRPYIILRKARSGLRMSHLLITPMAAPALTSHRVSPYLDFLWLQSSLTIFWEVMDHHIPMHALPEEIQKMLPEEKVCKYCGVSYLILHEFKAMEEKVKAMEKEMKFYQGSVDREKRLQEKLHSLSQELEQYKIDNKSKTERIYDVGMQLKSQQNEFQKVKKQLSHLQDELKIKYRQSYIFRLCFC

SEQ ID NO: 781746 - protein, 33 aa, Homo sapiens
PIPHFFISVPSTGPVLGTKQPKEKRQGCFPEGL

SEQ ID NO: 781747 - protein, 116 aa, Homo sapiens
QAEVRRCSVQENKLNTPTNSTLCSYPPAASPGPELSPVSLYRPSSSLTMAYLGPYPMSRQPPQMRLLPHNSLHRHSSIVTMGSLEPSSCLPAFSPSPELSQVDLTRPVEIFFTVWL

SEQ ID NO: 781748 - protein, 100 aa, Homo sapiens
SGLRWLRVVRGLSGAVGHPREASRGSKAWGPAVEVSPQLWAQLERGRPGVHEALKSAHPWPRPACRPLPVVSLSGESGSQPSPPLHWFPAGKGRGALSRS

SEQ ID NO: 781749 - protein, 52 aa, Homo sapiens
MPISVALKSGGPCQKFGWRWQVGSLEAEGKSGWRCKFRSHQPRMDFKTTGLD

SEQ ID NO: 781750 - protein, 42 aa, Homo sapiens
WDDLKVGFSDFPVTSLLNLWALSSSHHHCLLYAESPYAGLWG

SEQ ID NO: 781751 - protein, 78 aa, Homo sapiens
LKSMKSRLEKQYKKINEPKSWFFERINKIDRLLVRLVKEKIQINTRNDKGDITTNPIEIGKTFRDYYKSLYAQKTYKI

SEQ ID NO: 781752 - protein, 102 aa, Homo sapiens
RGFRQKMRSGCESQDVLSRWALGNIPSVPEARKWSESGISFRSPLVSFLIPASPCPMSCDFREASGYSELLSLGYNNNRARETGILVLLLPLASCAFLGKLL

SEQ ID NO: 781753 - protein, 88 aa, Homo sapiens
RGGQGTPTSGHHQSCRLSRTPSIAITGVLVKVQVLRPPGNLHFKQAFQLLLTHIKVRGQHGPSSVAHTYNPSTVGGQGRQITRGQEFE

SEQ ID NO: 781754 - protein, 118 aa, Homo sapiens
PSGQTGVGQHWAEAVWQARVSQKVVAGRVSPAQMLGRHGGMAHRPHSAWDQAPSEDTGSSFPWARPLERRRELGRENGTLVLRQAPSTHGLWAPGRAWPGCPRRRGGGSSCFMTPPAR

SEQ ID NO: 781755 - protein, 82 aa, Homo sapiens
CGMEDGAVLGTLTSPWPELPQTKESSHCGLLSGFHPSKGQAAGGLIGLAQAELMPLLEYHHLQACALAPPALCGLVTLAASF

SEQ ID NO: 781756 - protein, 76 aa, Homo sapiens
MGRMGTTAPAQPAAWSLPTTAPLVSSLRGVGPLGATNHRDPSSFSVGEILREGPKWNHRHKAWGACVGGSTGRDRI

SEQ ID NO: 781757 - protein, 148 aa, Homo sapiens
RRAPSWCRHSFASCVCWRYSACLIALFAYLLLLGYASSIPWLRRQFSNLDPMSPRGLRFNLGAHLHGIRALRPGSVRSHLVHFSSHHENVSVPLYAPREYVMKELRVGGYLERHKSKLYPCKRRGDYRSSCPVLDFSVIQSPSYLRYL

SEQ ID NO: 781758 - protein, 69 aa, Homo sapiens
MGFPVIHFANQPRVGFYLPIFINETCRGSLTPSAIQLITSTIKIQDSDSAPGCISGIAEEEHLVTPSLP

SEQ ID NO: 781759 - protein, 93 aa, Homo sapiens
MKGARWRRVPWVSLSCLCLCLLPHVVPGTTEDTLITGSKTAAPVTSTGSTTATLEGQSTAASSRTSNQDISASSQNHQTKSTETTSKAQTDTL

SEQ ID NO: 781760 - protein, 117 aa, Homo sapiens
SQLLGRLRQENRLNPGGRGCSDLRSCHCTPAWATEEDSVKKKEKRHQVCQGVREKASGMPGRVGKGIGYARVCGKRHRVCQGMWEKVVRFLSLPGLGSLWPSEAYPGWVLRHQLSSP

SEQ ID NO: 781761 - protein, 118 aa, Homo sapiens
QPSSRCRVPRAACGHQVDIEPRGGLALVNLPRIDGAPTLCQAQRIPQCKRRGNTLRHVIWRDMKQISRGKIMESLKAFKQGIISSPICWVLERHRLHCGRQRKSQRQGDPPPKWERVA

SEQ ID NO: 781762 - protein, 101 aa, Homo sapiens
PARTQGAAGEPPLGIQINVGSLPFGGPLRIPEFLLLKEEPVLRAFSAAISIWCTRPCHWQSWSHENHFLKKGSERVAFLCELICQDGGTRTVERGNDFGED

SEQ ID NO: 781763 - protein, 151 aa, Homo sapiens
IAVLEDTRSTVSEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDVFVPESDRSDYNCTGGTEVLANSNRNPSTVFW

SEQ ID NO: 781764 - protein, 106 aa, Homo sapiens
CPGHPVSEMSKTPALPSRNSRDPAAATVLQSNYHPGLQEPNVGWGQGRYKMLSELETKVSNTRSGAVKVTLKLCLEGGQERTRTRPWEPPVQSRETWNSRLVGTSD

SEQ ID NO: 781765 - protein, 67 aa, Homo sapiens
IPLLLASSVAESQAVAQLRGYVASLHLRGGVPPRLKLAGETNVEVRCGLLKSCLESEKAAGRSDSYL

SEQ ID NO: 781766 - protein, 41 aa, Homo sapiens
MRKKSKVEADLEHPQPPEATVNPQAKVNPQATVNPQATVNP

SEQ ID NO: 781767 - protein, 115 aa, Homo sapiens
GWGALGPSRAPWHLFTVRVLEPRALLGHYLRSGSGFSPLIFSQTVVRYQTSPGPSLRPNVQCPVPMPSWCNGTSAPSWCNGTSARLWRSIFPPNLPLTLPAVAGGVSALGNQIHC

SEQ ID NO: 781768 - protein, 42 aa, Homo sapiens
MAQTNSCFMLISCLMFLSLSQGQEAHAELPKAQISCPEGTSA

SEQ ID NO: 781769 - protein, 99 aa, Homo sapiens
SVLFGVGKNNQQEGGEKKKSWPSNGSLFVAPSVYTTTAQSAYFQAEKENYYGELWRASWAKADRMKLHNLPMRGTHWAGFCLPPTLVDGSSACPGGEMC

SEQ ID NO: 781770 - protein, 132 aa, Homo sapiens
RGRNLEGEREEQRASKRKSRDRGGKETEEGEIHQRWGEGEEGGGNTPEMGRRGRRRGKYTRDGEKGKKEGEIHQRWGEGEEEGGGERGCQRARRRQTQMKGQRPREEAGQSGLRGGSRGQGHKTQGVRYRAP

SEQ ID NO: 781771 - protein, 69 aa, Homo sapiens
AQVLSSLTQMLSEHTHYRLSWIVGQSLLYKHHSVDTGSEQMRPNRPAGPKTRAAQSPRGHGSHPDLSKP

SEQ ID NO: 781772 - protein, 106 aa, Homo sapiens
MKLGSRTERDRSSYFRWRGQRQPLSQGAVLQGAEGQKEPDRQRSGGRSCQAARTAYSKAVGVDPAQWVEETERSGDWSTVSQRRGGEAGKGWGQIPGSLWRAWKSI

SEQ ID NO: 781773 - protein, 41 aa, Homo sapiens
PTRKGKQPARSKYKRFTVNTLKLGKGPLHASIRLLVEKRGG

SEQ ID NO: 781774 - protein, 103 aa, Homo sapiens
FSCLSFRSSWDYRHVGPRLANFLYFLSREMVSLCLQSARLSLPECWNYVCEPGQGRTFEHLPVFYDTDPLGDNKDPLGDPGWTAGWSLRKESTQSKGEMVKPE

SEQ ID NO: 781775 - protein, 89 aa, Homo sapiens
SPPPSYLFSSREEQHRKHSRSPQEAPRFTSPGWRNATQTSRHSSLGHAYAGLGGATDTGGLGDLAVAKATEGHPNPQRLQSRAKLLLVD

SEQ ID NO: 781776 - protein, 35 aa, Homo sapiens
KPSSEGTGRGWGQVQRLRPEQVQSSRKERMLDSLN

SEQ ID NO: 781777 - protein, 38 aa, Homo sapiens
PFAGPYFSLLRLPKAQHCQAGTTCVPLCLPSHGCQQFG

SEQ ID NO: 781778 - protein, 225 aa, Homo sapiens
FTSTGAPLRRATSTSCSAISPSPLLAAQCRAVKPDMKSRLAAKPRSRSSSPCSWWVQRPPAVRTSHSCSDGSRGTADGGGAAGNSSASGLSRRGPARDRRLRCGERPGPRPRPRPDSSTESRLSSRGELRGLGSSDSCRRRPGSSARRRSVAGAGTQRTGSIQGFCCGGPFAAPGPGSASGGSEQGDAASEGALGGGAASAEGLSVAWASSRAGSGGSADRSPGG

SEQ ID NO: 781779 - protein, 42 aa, Homo sapiens
MLDPCCDTSDHPSLPMKTVTTKNETQTPAGLEEGNYRIYAWR

SEQ ID NO: 781780 - protein, 67 aa, Homo sapiens
EEPFLPFCLRSGARRAFGRNWAMRRALMNGISSLIRRDTKEVIFLCPLLCEDKVICSFLLLLMIFLS

SEQ ID NO: 781781 - protein, 57 aa, Homo sapiens
AEVQVLVLDGRGHLLGRLATIVAKQVLLGRKVVVVRCKGINISGNFYRNKLKYLAFL

SEQ ID NO: 781782 - protein, 280 aa, Homo sapiens
MWWCTPLRVSGKCRAGPLSAPRRGPSTLSLPRLPGVGVVPGTLGPPGSRACGWPLCTAPLVVSPHGPTSSGLAACSGFIAPAAPPRMPGEWVAEASWSLCPCCSVSWPFPDTSRHGIHRDSPDTLQGPGRWDRRAYRSHRQQIPRSLGGASLAAQPQLLRERASRFRGAGHKPVVATKPFLWWSACGARVGRVWNVCGARVGRVWGACGAGVERVRGACGAGVGRVWGACGADVGRVLGTASGMHRAQRGGEAAGAASTSSSIPIPPSGFLVKNLAGRSG

SEQ ID NO: 781783 - protein, 76 aa, Homo sapiens
NLIPTTQCALTHPLPRLTYCPSVLGTEEFPGTWNFKTGSVLGKPPYFYFTSVSLLNHTLRVLRHSVLQLSSLYLFY

SEQ ID NO: 781784 - protein, 172 aa, Homo sapiens
MDPSEKKISVWICQEEKLVSGLSRRTTCSDVVRVLLEDGCRRRRRQRRSRRLGSAGDPHGPGELPEPPNEDDEDDDEALPQGMLCGPPQCYCIVEKWRGFERILPNKTRILRLWAAWGEEQENVRFVLVRSEASLPNAGPRSAEARVVLSRERPCPARGAPARPSLAMTQEK

SEQ ID NO: 781785 - protein, 141 aa, Homo sapiens
GLADQAGGRPVGWGICPADLGREAGCSRVHLGDRGHFFVTVEVRTSRWRFSRVFLLGSGQCWESGPPAPGWTGHHGVLPSASASLPELGVSSQTVSIARGKRRSHRFPGAGDSIGGPQEAWPGEHGSTSRSRLGKGGIPSS

SEQ ID NO: 781786 - protein, 104 aa, Homo sapiens
MVISHKLETERGPMLFFWDSERDGNLSYPISLSSQPQVLGWRQHSRGAQNRWSPGKWENIGRRLSRESEMTLGGFSDRPASFWKLLHFSLQETSIPWSHLSRAI

SEQ ID NO: 781787 - protein, 379 aa, Homo sapiens
AVRPRLRRKRRPCSERGSGAAPAGGSLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGLPVLLLMLALSPDMPVGRTGKHSKHRTLYCCGYPEPSTLAGMKDRQTLWHYKTELPFQWHRDLAIIRAPQLRLGKPGLVENLTSDRLGSTGTGASLGAHQGAAPAPGIPHPSARLVVVKLTL

SEQ ID NO: 781788 - protein, 113 aa, Homo sapiens
TPPAGLGLRTQGAPRTEPLRLKPTERIPPLDDGEGVGATGRQIGGSRPAQPALPSQRALEPLGPSRCPPGSAARLGQGSAGGRGLRAVGPSTHASSLLSGGSRAAAGDREQEG

SEQ ID NO: 781789 - protein, 108 aa, Homo sapiens
MLGVVYANGQAPGTLQVSPGTKRCLLCPEEQYSSRTRDGCLPRTETFLAFDDPLGLMLALVALMLASLAVLVLQTVLKHRDTPVVGANNRALSCTPLTSLTLCALCPL

SEQ ID NO: 781790 - protein, 72 aa, Homo sapiens
GLVWALGYSWVVGPSPGSSPFTPVSLWVLTSLQLPPTGDNTARPHPAWARACELVCVHPSVHVRVRAHQGPP

SEQ ID NO: 781791 - protein, 135 aa, Homo sapiens
AHLTPQIHFLSCELSLRKWHHHSGQKAESPSLSPATFYLHCSLSPSDMLSPPPPRASVLAAPSLQCVPYPRVSQSSPLSALKSGGFRLTRGSLATLANVMLFHLLSSECCYLKMFSSLIYNFTVCILSLVNKDFR

SEQ ID NO: 781792 - protein, 36 aa, Homo sapiens
LLVLCLKPFATLEAHASVFAVRWRHAPSPLLREAGE

SEQ ID NO: 781793 - protein, 132 aa, Homo sapiens
RQQRVPGLRQQRGRRRAEAEVTKAAAAAAVSLTVAETKAAAADGERPGPGPLLVGCGRAAVGPARLPPPAAPPPAPPPGRRRGPGPARTQTAAAAAAGGVGGGGGAMGGLASGGDVEPGLPVEVRGSNGAFY

SEQ ID NO: 781794 - protein, 159 aa, Homo sapiens
EWLLLWELLRMGLMRHSVVTVAPVPVLSGPMGWWLLYTTVWMRRCHCRREFYQMEMAQAGNSRKHAKSTENQSEARRGRPGKPPGKAGALVQPLWCGAWPGVTTVKGIATFAHTWQNNKTRQLSQAEPQTARLLTAPALCAQVRLRVQALSPPQDSAVA

SEQ ID NO: 781795 - protein, 211 aa, Homo sapiens
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTGSENRAESCRNEMGSSGGDPKILACGEMPGSSSY

SEQ ID NO: 781796 - protein, 37 aa, Homo sapiens
MPRFCIQALDSLPNPSSPRRCSQQERLGFAATNQPGP

SEQ ID NO: 781797 - protein, 70 aa, Homo sapiens
RARYPNLYIIAQTTDIYMNVLCHASSRCALAIHASFKDSESVEKKRLRSNSALVPTQMLRNTPWNLITGR

SEQ ID NO: 781798 - protein, 91 aa, Homo sapiens
MGGPDGFESRLMIRKVGVPNCGCQVDPGPANIPNLKGSPGEKRTRERLPKYGKTGLTEWVETTSWVSQNSSQCEHKKHRGRGRKKPLRKNS

SEQ ID NO: 781799 - protein, 374 aa, Homo sapiens
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDS

SEQ ID NO: 781800 - protein, 279 aa, Homo sapiens
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYK

SEQ ID NO: 781801 - protein, 289 aa, Homo sapiens
SSDPPASASQGTVIVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDS

SEQ ID NO: 781802 - protein, 124 aa, Homo sapiens
GGKQRLPLTILQPSLWLLTALHLLWTSSLQYVKQPFQPAWTKERSQDGAEKPMQAGPGTQESGTRCYQMLAPTRVAAVFSVPQLCPLSLQAASSQGDLDGITTLVCLVNTETNSTIQRPDRQMA

SEQ ID NO: 781803 - protein, 98 aa, Homo sapiens
GGKQRLPLTILQPSLWLLTALHLLWTSSLQYVKQPFQPAWTKERSQDGAEKPMQAGPGTQESGTRCYQMLAPTRVAAVFSVPQLCPLSLQAASSQGGR

SEQ ID NO: 781804 - protein, 78 aa, Homo sapiens
GKAEQIRKGALRNLWCRAMIEWIPTNISLSKNCWQLAQLTLKFWMLQFLPNLDGITTLVCLVNTETNSTIQRPDRQMA

SEQ ID NO: 781805 - protein, 108 aa, Homo sapiens
MSVLKVTPFDFANIPEPCEHMNIPKKKIPPGSSDESHSVAQAGIHWHRLSSLQPPTPWFKRFSCLSLPSSWDYSFSKAIRLQNLVLLCAQKENEKDFKNHSGLSLLQE

SEQ ID NO: 781806 - protein, 115 aa, Homo sapiens
LSSSIFQGPHSCSPRFSSLNNVTVPAPFAEPGGSSSENCGLGRRSQKGERPHATPTQRTPPNADPDPKSWPAHTHRTTVDPPRRMLSPSFTPGQTASQTLLTSPRSQANQRQGRL

SEQ ID NO: 781807 - protein, 102 aa, Homo sapiens
DPKCLQTLPSVCWGEGWGGAVQNHLMLKTIYVGKDVVGDGRCTFSLWGRHLVKGKKKTLLQKKKKGNLKLNTLLKDTIACIFFQFYFCTIILGILVGKLFLT

SEQ ID NO: 781808 - protein, 134 aa, Homo sapiens
FPPASGCAPVSLSLSAATCYSPPLGHLHTACDLSHLLQTFLEPSNLQFLSPHSKQSPSKELFPFNIYHSHLNPFETGLRPHNSSTETALVKATGGLHVAKYKGQVSSSLHLTSRIILDTFSMWLPGLHIPWFSS

SEQ ID NO: 781809 - protein, 72 aa, Homo sapiens
FFKVLGSKDSQCFRMHSRGVPAEDGLLPICKRDKNRGFLGLLVLFNVTQGGGDTVGESSWLFSLLGPRVPAP

SEQ ID NO: 781810 - protein, 70 aa, Homo sapiens
RHQLVLRARRKELPPELGGVALGMPHRPHLSTELRVASPIAPTPHAPWPRTGARLGQGSPRGRGYPNFRA

SEQ ID NO: 781811 - protein, 31 aa, Homo sapiens
MPTQHSKTSPVIPNPGLTTPNHSRGKDTERR

SEQ ID NO: 781812 - protein, 126 aa, Homo sapiens
TKPRVFHCDQIKFLVTPLGMPALEGSPCGHTLGIHPKVLGRLFPKMIEPVASWRTSGNICYSSKIQVKTRILENLTSLAMSLVSSQHLETFLVRSVGVTDGMFPPLPVKCVSLWKTYLTRWEILPE

SEQ ID NO: 781813 - protein, 101 aa, Homo sapiens
QGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEAC

SEQ ID NO: 781814 - protein, 115 aa, Homo sapiens
MALRAHKREPPARDAAGLLPCPLSTPEPCTQTPPPRQSTPAGQASQTGERPSTRTSLGHTLRHQTGDSWWAHGLAREHEAAVPGRPHHHQVGHKCLLRHPQGDGLRSREQRKPVP

SEQ ID NO: 781815 - protein, 106 aa, Homo sapiens
PCQHLELSNGRFRLPPRVTPPLPADLDAGIPSELASNVSKTHHVFFLPVPCPCAKWPGRVPSAQDMVLLRVPAAQLLLGPTKIHSPFPCDLILTFLTHTLPHMVSM

SEQ ID NO: 781816 - protein, 86 aa, Homo sapiens
GFAGAVQLGLIGTRIRARIRVQFFIFIQIPNDLVKMHILTPEGCGLRFCISNTLPGDVTMLVHGPYSSSKGINDMITLPNNTKRPR

SEQ ID NO: 781817 - protein, 115 aa, Homo sapiens [sequence omitted]

SEQ ID NO: 781818 - protein, 91 aa, Homo sapiens
QNPGRPDCGLGKVWKQSSASDMPDIPRAAGSDVGTCPGSARSARSILPRPPPEGPRAASPSPRGTPTCCVWGSGRPGSSQYGGGAAPTTKS

SEQ ID NO: 781819 - protein, 36 aa, Homo sapiens
REESLSEEQPGSLAHQGLMMSPALDELWGSYIPPRQ

SEQ ID NO: 781820 - protein, 580 aa, Homo sapiens
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 781821 - protein, 101 aa, Homo sapiens
GGSDCPKSTQPQKGYSGNKSRLNPPAAPGSSPSTVLYCAVLIIFQLGRTPISGIKPWTNLLIILEIILIRNPRRKSYRVPHPLFSSLELFRHFIIFFLNQS

SEQ ID NO: 781822 - protein, 141 aa, Homo sapiens
GLPVLKQRKPGATQVKLSALPGQSLEGLQSGGETSMGIESQSRVRPALMGAIEVQQGGPAAGHDSPRPHRTSRWMKENGKGDQGRSKLVQRPNDARSWHASGIQGVCGRVSFLLRSGSERPGTVAHTCNPSTLGGQGGRIT

SEQ ID NO: 781823 - protein, 622 aa, Homo sapiens
ASEPSVCGQSRDFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFS

SEQ ID NO: 781824 - protein, 143 aa, Homo sapiens
MAALGDIQESPSVPSPVSLSSPGTPGTQHHEPQLHLHGHQHGSPGSSPKVLSQPSDLDLQDVEEVEIGRDTFWPADASRGGDCSPQPPAPVAPRGLLPAPAGHSESGTPPSPPPALGWGFWLRAPLSPQIHELSCVPSSSCIP

SEQ ID NO: 781825 - protein, 376 aa, Homo sapiens
MAALGDIQESPSVPSPVSLSSPGTPGTQHHEPQLHLHGHQHGSPGSSPKVLSQPSDLDLQDVEEVEIGRDTFWPDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQCGRAFSHSSHFTQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 781826 - protein, 380 aa, Homo sapiens
VPAALGHPATPPTPVSMSALLGTALRAPVRLSPIHWVPGPSLSPLSPPVQLCSHSPSPSLRATVGACGYYPPLPFLISDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQCGRAFSHSSHFTQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 781827 - protein, 122 aa, Homo sapiens
MQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 781828 - protein, 332 aa, Homo sapiens
MAALGDIQESPSVPSPVSLSSPGTPGTQHHEPQLHLHGHQHGSPGSSPKVLSQPSDLDLQDVEEVEIGRDTFWPAESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQCGRAFSHSSHFTQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 781829 - protein, 305 aa, Homo sapiens
MAALGDIQESPSVPSPVSLSSPGTPGTQHHEPQLHLHGHQHGSPGSSPKVLSQPSDLDLQDVEEVEIGRDTFWPDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRSSLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 781830 - protein, 134 aa, Homo sapiens
MASPQPGWSCVQVPCTSPLRSSQGSLWAMLVIWLDLTVLSPRPHLGGPGVGSRCLRSGPWKETLGQRFAWEAPGVGMGAGRQHTCHRGLGQPHEELCPYGPHPRQGFEAPSGALASPRLRVLTNTLCFLLAKGD

SEQ ID NO: 781831 - protein, 376 aa, Homo sapiens; identical to SEQ ID NO: 781825

SEQ ID NO: 781832 - protein, 194 aa, Homo sapiens
RGRTLPSGARRPPPARKVPGVTPSAGLREDGSPRGHSGVPFCPVPCQSLITGDTWNPAPRASASPPWASTCQESTHLPPVPRRVQPPHLHLEDQPQQGCQVLSSGVPAQGKGGKAVSGDVLTAPSVGAWRWSLPCIWPSVEQASSPGCQGMVTWCPQACLHNGEGIRKTQRWFGTPTSCFGAAKQFWTLGSRGR

SEQ ID NO: 781833 - protein, 196 aa, Homo sapiens
MAALGDIQESPSVPSPVSLSSPGTPGTQHHEPQLHLHGHQHGSPGSSPKVLSQPSDLDLQDVEEVEIGRDTFWPAQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 781834 - protein, 107 aa, Homo sapiens
MASPQPGWSCVQVPCTSPLRSSQGSLWAMLVIWLDLTVLSPRPHLGGPGVGSRCLRSGPWKETLGQRFAWEAPGVGMGAGRQHTCHRGLGQPHEELCPYGPHPRQGL

SEQ ID NO: 781835 - protein, 163 aa, Homo sapiens
MTRALCSALRQALLLLAAAAELSPGLKCVCLLCDSSNFTCQTEGACWASVMLTNGKEQVIKSCVSLPELNAQVFCHSSNNVTKTECCFTDFGNNITLHLPTASPNAPKLGPMELAIIITVPVCLLSIAAMLTVWACQGRQCSYRKNKRPNVEEPSLSASGNVE

SEQ ID NO: 781836 - protein, 175 aa, Homo sapiens
MTRALCSALRQALLLLAAAAELSPGLKCVCLLCDSSNFTCQTEGACWASVMLTNGKEQVIKSCVSLPELNAQVFCHSSNNVTKTECCFTDFGNNITLHLPTDNGTWTQLWLVSEYHEQGSLYDYLNRNIVTVAGMIKLALSIASGLAHLHMEIVGTQGKPAIAHRDIKSKNILVK

SEQ ID NO: 781837 - protein, 111 aa, Homo sapiens
MHSAHEASCRDHHAETTIPRGCPWETLSVHSLPSLRTHEEPGFVPLTWVQTGTASQLCPQKLPVLRGGWAEVLPNNYRGGQAYHRGILTCFCPSALTSLSDCTPVTQPMAS

SEQ ID NO: 781838 - protein, 56 aa, Homo sapiens
MAQGYKRPKEKSLVICRQAPSILIRDLDNDVEDKTRSAGNIIGRGRVSNRSWCLRD

SEQ ID NO: 781839 - protein, 117 aa, Homo sapiens
MSIILNHSLELAGPRGCSNSTHGSLGYRARELGGLEEAQSGGRPRIFPLSNPKVCSMNLWPKDNAPGNGSRAGCFASRTAVPASREVEVTLSLPGGGGAPASQGTASRGSAPHTRRP

SEQ ID NO: 781840 - protein, 216 aa, Homo sapiens
GSRQRAPEPPEEKELERKMEEQTEGGEGGRRCSSPKRGGRRCSSPKRGGSPLGKMRTEPQGGLGLAKGACSFFVGAGASRATSLSCACVWTSPQSVCLPGVPRLRVAVARRRRPFGSLCELEGAPWASGPGQVRDRNGVRGPMRAPRGNVRCGRPRRPHLTPGRERGRAQFTGCSSPDEAAGGCLASTLTFWAGGPRTGQAVAATGARKRRRQLAP

SEQ ID NO: 781841 - protein, 108 aa, Homo sapiens [sequence omitted]

SEQ ID NO: 781842 - protein, 311 aa, Homo sapiens
MAGPLWRTAAFVQRHRTGLLVGSCAGLFGVPVSYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRTASLSAAYACGGVEFYEKLLSGNLALRSLLGKEGEKLYTPSGNIVPRHLFRIKHLPYTTRRDSVLQMWRGMLNPGRS

SEQ ID NO: 781843 - protein, 131 aa, Homo sapiens
GRPAARTCRRSERRRRLSAVTTLMAGPLWRTAAFVQRHRTGLLVGSCAGLFGVPVSYHLFPDPVVQWLYQYWPQGQPAPLPPQLQSLFQEVLQDIGVPSGHCYKPFTTFTFQPEREHHRKVKKFALNHKTL

SEQ ID NO: 781844 - protein, 311 aa, Homo sapiens; identical to SEQ ID NO: 781842

SEQ ID NO: 781845 - protein, 108 aa, Homo sapiens
AALPRAHVGVPSGGGGERTDEREGPFSGLMRPGNAFRLRSSLGAQSGSVARTPLRGSCSPSSPSHRRAAWYCVLGPPRSAMALGTLDFGPDLSFLSLTFRIGKKKKPE

SEQ ID NO: 781846 - protein, 108 aa, Homo sapiens; identical to SEQ ID NO: 781845

SEQ ID NO: 781847 - protein, 319 aa, Homo sapiens
GRPAARTCRRSERRRRLSAVTTLMAGPLWRTAAFVQRHRTGLLVGSCAGLFGVPVSYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRGSPEHAGVDGLKKRRERRQTWRTEREQRDGTRAELPTPDGEGETRQRHKGHQRARSNEKGTR

SEQ ID NO: 781848 - protein, 334 aa, Homo sapiens
GRPAARTCRRSERRRRLSAVTTLMAGPLWRTAAFVQRHRTGLLVGSCAGLFGVPVSYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRTASLSAAYACGGVEFYEKLLSGNLALRSLLGKEGEKLYTPSGNIVPRHLFRIKHLPYTTRRDSVLQMWRGMLNPGRS

SEQ ID NO: 781849 - protein, 296 aa, Homo sapiens
MAGPLWRTAAFVQRHRTGLLVGSCAGLFGVPVSYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRGSPEHAGVDGLKKRRERRQTWRTEREQRDGTRAELPTPDGEGETRQRHKGHQRARSNEKGTR

SEQ ID NO: 781850 - protein, 108 aa, Homo sapiens; identical to SEQ ID NO: 781845

SEQ ID NO: 781851 - protein, 74 aa, Homo sapiens
MHYVVLDAGLLAKHVELAPYMCINPNQEILKFMNTGYMSKVNLPILCQSKSKSLMRRKARSPERTLGVGDKQSE

SEQ ID NO: 781852 - protein, 105 aa, Homo sapiens
APPPRPIGPGAGASRALGAPSGYDESQVGPGSRPAGERSRAPQAGSVTPGGERRAGGGTSATGLGRGRAAAAGSCSPAVVGGAAAHARCTEACFTSVTTGGGPAS

SEQ ID NO: 781853 - protein, 1155 aa, Homo sapiens
MAASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781854 - protein, 185 aa, Homo sapiens
RTSLETSSLSLAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781855 - protein, 1222 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781856 - protein, 1222 aa, Homo sapiens; identical to SEQ ID NO: 781855

SEQ ID NO: 781857 - protein, 1222 aa, Homo sapiens; identical to SEQ ID NO: 781855

SEQ ID NO: 781858 - protein, 1207 aa, Homo sapiens
LPGSALSAGCFLSPRVPDRVHSDRAQHRQRQCKLPPPRLPPMCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781859 - protein, 939 aa, Homo sapiens
GRDMLPPFNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781860 - protein, 1222 aa, Homo sapiens; identical to SEQ ID NO: 781855

SEQ ID NO: 781861 - protein, 1204 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQASPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781862 - protein, 730 aa, Homo sapiens
MYEGWFNLAEAVREGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781863 - protein, 704 aa, Homo sapiens
TEDVRTAGTRFVISLRWTCRFQPVNYMAPRLTMYSPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781864 - protein, 401 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHGGHTVTEPMADVFHGSQVQWQRLRPGLLSGAPASCAAADRRGRAHP

SEQ ID NO: 781865 - protein, 106 aa, Homo sapiens
MAAARRLMALAAGISPRLQPLGPRAAGRQGRSRGFSSSCAHPDHTKEAAEAESGMAPGGPGEGDGSLVNGEGIGGGGRSAAPLTPGMAELGARAEIGPGGRGSSLP

SEQ ID NO: 781866 - protein, 1194 aa, Homo sapiens
MFSLDSFRKDRAQHRQRQCKLPPPRLPPMCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781867 - protein, 183 aa, Homo sapiens
MVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGQSGPHLLS

SEQ ID NO: 781868 - protein, 1194 aa, Homo sapiens; identical to SEQ ID NO: 781866

SEQ ID NO: 781869 - protein, 1185 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781870 - protein, 1035 aa, Homo sapiens
MPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781871 - protein, 866 aa, Homo sapiens
MYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781872 - protein, 1254 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRGGCLQASRPPRSAAAPPGPGSPQFPTIFSIPSDDGRRATISLSDSDLLRLEGDSRTVRLLKELRRALGRMVERSLRSELAALPPSVQEEHGQLLALLAELLRGPCGSFDVRKTADD

SEQ ID NO: 781873 - protein, 1213 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 781874 - protein, 1013 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGQSGPHLLS

SEQ ID NO: 781875 - protein, 465 aa, Homo sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPSH

SEQ ID NO: 781876 - protein, 114 aa, Homo sapiens
MKLKVKTLSSHNINPSKKGDCGLGSMAHACDPSTLGGRDGRITRSGMETILTSAVKPCLYWKYKKSAGRGGGRLWSQLPGRLRQGNGMSPGGGACSGPRLRHCTPASETEQHSA

SEQ ID NO: 781877 - protein, 100 aa, Homo sapiens
SRCNVRSHWRAQGLLASRDRLHSAGARRSGGRLSAVGLALTCRTPGPGAWANLGPLGVQRGPSARAFREWTCAPLGPAHHPPPTSVGPPWGEEKMPEADT

SEQ ID NO: 781878 - protein, 81 aa, Homo sapiens
AGLSPRYNVIPNECTSKSSIKVSINHFDLCGWIKHISISDIDRVLLNFTVSCHMPYVIADCTLLNLEPKPVVNTLHPIRYQ

SEQ ID NO: 781879 - protein, 70 aa, Homo sapiens
SDKTGRQEVNVSKARRCANTGRENRSRGAQLGELQETDLKKSKAELRIYSLVPTALQGPRYKDIQPAVVV

SEQ ID NO: 781880 - protein, 238 aa, Homo sapiens
MLFLLSAGRWLCSPPDQLWKVKKALKMTIFWRGLMPEFQFGTYSESERKTEEYDTQAMKYLSYLLYPLCVGGAVYSLLNIKYKSWYSWLINSFVNGVYAFGIPLHAAPALCELQVEVSGTSALEGLHYKASTAFIDDVLPSSSPCPRFTPAGLLSGDDVVVTVYLVPAEGLILGDKRTSDELGTHKEGHGAKERAQGARQAQDERLGRGEPEGRTNEEEHHRKRGKPGSERQRGEGEG

SEQ ID NO: 781881 - protein, 71 aa, Homo sapiens
IGGGGPAGPLRPVGTVPTLLSNLHLKLAAGGGKMTWVGASTKPGRTQRQSPALASWEDAQRPYKAAREGEI

SEQ ID NO: 781882 - protein, 62 aa, Homo sapiens
IPVMFRSTFPGAFARSLLKALPAFTHGLTEGVRRLPHMLGSATAVPHFQVPNPVPGICCCIA

SEQ ID NO: 781883 - protein, 124 aa, Homo sapiens
ALDYGGTLLSLPGQFATSVGCVCAGLFCFKVLEHSMCTTWKTSEFLHEINFAQESGHIDTSTFGGAWCTPGTVWGERVPFRSEFPDPGHSALLLVGRVKSVMISRTPPRFSFQFIAHSGLKTVL

SEQ ID NO: 781884 - protein, 68 aa, Homo sapiens
GFAGAVQLGLIAEFEARIRLEFEAREARTALRKDEKGVEKMLERENFRFYTKNNGNIKMKGSKSLNTK

SEQ ID NO: 781885 - protein, 98 aa, Homo sapiens
TLSRVRDARGETLCSDTGAVVAVWNQRGNRCAGAQWLEGSGGVVSGHFQAEGSTCPLGGAASALPPPPQGAGPLFISPSQHRPILGSGLSQARWPPCH

SEQ ID NO: 781886 - protein, 104 aa, Homo sapiens
TGVSHCARPPVLLSVPPFGFVLAHPQNLGYLLHFLPSSLGGKTKTISVPYFRATFYRKSYFQKMAATISLTLNVLFQYDFTTPLIKNRSLFLLLLDLDWPKQHA

SEQ ID NO: 781887 - protein, 60 aa, Homo sapiens
RSLAEQFQRMQGVSMRDSTGFKDRSLSGSLRKNSSPSDSKPPFSQGQEKGHWPWAKQQSS

SEQ ID NO: 781888 - protein, 75 aa, Homo sapiens
HHTCHLPGKREPRSRGLASHRPSWRGGQRAARQHRLSSSCQSHYQHGKITILVGNYYLEVGPEMQVKPQDATTQP

SEQ ID NO: 781889 - protein, 113 aa, Homo sapiens [sequence omitted]

SEQ ID NO: 781890 - protein, 203 aa, Homo sapiens
GGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRAKGFVTAVHEGYEKDLWEYIED

SEQ ID NO: 781891 - protein, 161 aa, Homo sapiens
MRVPTLQPQPVPICVPQTQRCPPQRRRHGPLPPCITVPCSHRLPVHPLPCCDLLCLCFLLGKTGIPQRAAVQQDKFTHETLGMLLAHRQGEASLVPIVTFSISSGCITKCHRLRGLHSRNLLPPSSGGQKAKIKVPANSVSVEILFRLLTISSQGLFSRHA

SEQ ID NO: 781892 - protein, 99 aa, Homo sapiens
FSFLLPCEEGCICFSFCHDRKFPEASPAMLNCKDTFRRGTKAWKEKHQGNDAYVSPPPSGLPPVLPLAEANQKPQDSITQAGVQQRDLGSLQRPPPGFK

SEQ ID NO: 781893 - protein, 83 aa, Homo sapiens
FSFLLPCEEGCICFSFCHDRKDTFRRGTKAWKEKHQGNDAYVSPPPSGLPPVLPLAEANQKPQGKGSQAIGHPQVSHPGFGAS

SEQ ID NO: 781894 - protein, 60 aa, Homo sapiens
LSVFGDIWENRIPEVTGWGAKLWLPGCKADVQGERSQAPLVAGGWGYKMVSSKLQGGVGW

SEQ ID NO: 781895 - protein, 41 aa, Homo sapiens
MSTNASASFPGGTGTGTSTRTSTGTGTSTRTSTGTGTSTRT

SEQ ID NO: 781896 - protein, 89 aa, Homo sapiens
SQTGQQAYSCAPEVDHQPSTSPLDQGPGDSRDHPGPRQDPRLLEPLIVGSPTVDSIVDPAAVMLPGSKSIWLQSHRQTHLPGNLYCLGT

SEQ ID NO: 781897 - protein, 79 aa, Homo sapiens
GSQQASLPLPSCSLYALPPAFHPVDDNARWMQCSSIGYLAPQIICGKEWGLLNCPLPMGCRVTVPEGSPSGHSWPGVAL

SEQ ID NO: 781898 - protein, 52 aa, Homo sapiens
PTTGWTGRQLGGGKEPVCKIEDRSTLFCTGSENDSQGEGGRSGSSVPNVNEV

SEQ ID NO: 781899 - protein, 371 aa, Homo sapiens
QNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRILEVNGRDVTGRTQEELVAMLRSTKQGETASLVIARQEGHFLPRELKGEPDCCALSLETSEQLTFEIPLNDSGSAGLGVSLKGNKSRETGTDLGIFIKSIIHGGAAFKVG

SEQ ID NO: 781900 - protein, 81 aa, Homo sapiens
TRCSARRRVHPVRASNLLNGKVISVRRGVEGGGRELSIGEENEHVVPCTLVPHDEGRTKSQALSDEGKDRMTQGRDGPTPG

SEQ ID NO: 781901 - protein, 111 aa, Homo sapiens
TGCRKYRRDANVASRGANPDTSHPRGLTTATHTYQGAPPTGAGACRSPKPSANKPLSPLFLLPRPPFLPTVLQAPGDWCPGTNMNRQTRSMLAAKPRPSRVPRTLISASRR

SEQ ID NO: 781902 - protein, 55 aa, Homo sapiens
AASGLSLALASEEQPPELPSTPSPVPSPVLSPTQEQALAPASTASGAASVGQTSA

SEQ ID NO: 781903 - protein, 875 aa, Homo sapiens
LQAGGPSAALGAPAPPLLLLGLSCPGSARAWGEARRARTRSMAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEICQSHKPCEIDPVKLKDGENLENNMENLRQYVDRVFHAITESGVSCPTVMCDIFFSLREAAAKRFQDDPDVRYTAVSSFIFLRFFAPAILSPNLFQLTPHHTDPQTSRTLTLISKTVQTLGSLSKSKSASFKESYMATFYEFFNEQKYADAVKNFLDLISSSGRRDPKSVEQPIVLKEGFMIKRAQGRKRFGMKNFKKRWFRLTNHEFTYHKSKGDQPLYSIPIENILAVEKLEEESFKMKNMFQVIQPERALYIQANNCVEAKDWIDILTKVSQCNQKRLTVYHPSAYLSGHWLCCRAPSDSAPGCSPCTGGLPANIQLDIDGDRETERIYSLFNLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 781904 - protein, 768 aa, Homo sapiens
LQAGGPSAALGAPAPPLLLLGLSCPGSARAWGEARRARTRSMAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEICQSHKPCEIDPVKLKDGENLENNMENLRQYVDRVFHAITESGVSCPTVMCDIFFSLREAAAKRFQDDPDVRYTAVSSFIFLRFFAPAILSPNLFQLTPHHTDPQTSRTLTLISKTVQTLGSLSKSKSASFKESYMATFYEFFNEQKYADAVKNFLDLISSSGRRDPKSVEQPIVLKEGFMIKRAQGRKRFGMKNFKKRWFRLTNHEFTYHKSKGDQPLYSIPIENILAVEKLEEESFKMKNVSVGPPSLSFGLRPGQVFSALFPYLALGSPFPTHCTPGFSESSCYSGCSPGAGEFVSESRIKAATLSVPGVTGVGWNLPEGGA

SEQ ID NO: 781905 - protein, 252 aa, Homo sapiens [sequence omitted]

SEQ ID NO: 781906 - protein, 847 aa, Homo sapiens
MHTSKGWKRVCDVAGNKHFYAADDVCRFYFLGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEICQSHKPCEIDPVKLKDGENLENNMENLRQYVDRVFHAITESGVSCPTVMCDIFFSLREAAAKRFQDDPDVRYTAVSSFIFLRFFAPAILSPNLFQLTPHHTDPQTSRTLTLISKTVQTLGSLSKSKSASFKESYMATFYEFFNEQKYADAVKNFLDLISSSGRRDPKSVEQPIVLKEGFMIKRAQGRKRFGMKNFKKRWFRLTNHEFTYHKSKGDQPLYSIPIENILAVEKLEEESFKMKNMFQVIQPERALYIQANNCVEAKDWIDILTKVSQCNQKRLTVYHPSAYLSGHWLCCRAPSDSAPGCSPCTGGLPANIQLDIDGDRETERIYSLFNLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 781907 - protein, 445 aa, Homo sapiens
LQAGGPSAALGAPAPPLLLLGLSCPGSARAWGEARRARTRSMAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEKL

SEQ ID NO: 781908 - protein, 99 aa, Homo sapiens
EDGQVPGGLLHVLSHETSCALSWAHLCPQMFQVIQPERALYIQANNCVEAKDWIDILTKVSQCNQKRLTVYHPSAYLSGHWLCCRAPSDSAPGCSPCTG

SEQ ID NO: 781909 - protein, 78 aa, Homo sapiens
VDCCGDKQNQSRRAARKLCVPKSHHTGREALPMFFCLFVFVCFVLFFETKSHSCAPGWSAMARSRLTATSTSQVQPPE

SEQ ID NO: 781910 - protein, 223 aa, Homo sapiens
KDESLCLSSSCEGAAGTPRPAGEPAWVTQFVQKKEERDLVNRLKAEQARRKQREERLQQLQHRVQLKYAAKRLRQEEEERENLLRLSREMLETGPEAERPEQLESGEEELVLAEYESDEEKKVASGVDEDEDDLEEEHITKIYHCSRTHSQLAQFVHEVKKSPFGKDVRLVSLGSRQNLCVNEDVRSLGSVQLINNRCVDMQRSRHGSHQDHGVAAGGLERVR

SEQ ID NO: 781911 - protein, 35 aa, Homo sapiens
MSAGVVRSSLPKEGLHSLKMASLPGYTSEGILEAA

SEQ ID NO: 781912 - protein, 51 aa, Homo sapiens
VLKLHEGAFGAENTGVSRAMLRGAGLSCCFREWVSQKACGEGGSWCPYSPP

SEQ ID NO: 781913 - protein, 73 aa, Homo sapiens
GLEGKVLATDLIWLPSLDSLFWDTHWAPNLKLLDVKREPGCYSERGLVSSSTKSWCHIANLSKVESGIAIYIY

SEQ ID NO: 781914 - protein, 126 aa, Homo sapiens
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 781915 - protein, 277 aa, Homo sapiens
TLPLASGRRRGGRRIRGRRERRRRGAIPPRRSIRRPQPSGGRPRGLGEGTAASVCAALGREGRQAADTAAFPAGGAQPWRRRGLPGHPQVTPGGGRATSSAGDTRAQGPPGQRRAGAEPRGSAGPDGALPRQPRAGRPRVAAWGGGLQRGPRAESPPGGQAMTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRL

SEQ ID NO: 781916 - protein, 106 aa, Homo sapiens
GLRGRFSSGLRPAGLEKLRLCASVSFSVKWEVQRGANVCAALGTPGSGSTGQWRWQQGICTCALAGPALGSSTCGSRLRIPTGFSGRGSARCTRWGLGAPPGRVSL

SEQ ID NO: 781917 - protein, 547 aa, Homo sapiens
MDIIFGRNRKEQLEPVRAKVTGKIPAWLQGTLLRNGPGMHTVGESRYNHWFDGLALLHSFTIRDGEVYYRSKYLRSDTYNTNIEANRIVVSEFGTMAYPDPCKNIFSKAFSYLSHTIPDFTDNCLINIMKCGEDFYATSETNYIRKINPQTLETLEKVDYRKYVAVNLATSHPHYDEAGNVLNMGTSIVEKGKTKYVIFKIPATVPEGKKQGKSPWKHTEVFCSIPSRSLLSPSYYHSFGVTENYVIFLEQPFRLDILKMATAYIRRMSWASCLAFHREEKTYIHIIDQRTRQPVQTKFYTGAMVVFHHVNAYEEDGCIVFDVIAYEDNSLYQLFYLANLNQDFKENSRLTSVPTLRRFAVPLHVDKNAEVGTNLIKVASTTATALKEEDGQVYCQPEFLYEGLELPRVNYAHNGKQYRYVFATGVQWSPIPTKIIKYDILTKSSLKWREDDCWPAEPLFVPAPGAKDEDDGVILSAIVSTDPQKLPFLLILDAKSFTELARASVDVDMHMDLHGLFITDMDWDTKKQAASEEQRDRASDCHGAPLT

SEQ ID NO: 781918 - protein, 159 aa, Homo sapiens
RPWTAAALQSLSPAVLGCLTFYTPPSASDILYLRSKKPSMNKDLGPSRLIILVGNGPTSSPHLHPALPLPHWTLAVNWDFSRAEPHLTEVKCPTAAGPSTWLSGDVGIGEVSIGSDSSVDASTVVSVMTSGLIAAWINSGVDTQEGQILPQDFSNPSSR

SEQ ID NO: 781919 - protein, 88 aa, Homo sapiens
ERCPGGAGSGTELTRASGHILVTAATEGPVQNHGTCRSHGPRRGGEPPKQDETNPGRHTRSCTLSIAPRLPSGLMYWSTDTGKQKSEP

SEQ ID NO: 781920 - protein, 102 aa, Homo sapiens
SLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCP

SEQ ID NO: 781921 - protein, 187 aa, Homo sapiens
MGKDQELLEAARTGNVALVEKLLSGRKGGILGGGSGPLPLSNLLSIWRGPNVNCTDSSGNTALHHAALNGHSGHQSPTYFSYEASTNVARQQRVSSYSAWLAWHSAMWQRDALVSRTSSPGHDQPMNITARQGHSMDATTAPKIHDDITHGTLDRAHAQWTRPRTPRRTIAECTRRQPGATHEEKSA

SEQ ID NO: 781922 - protein, 108 aa, Homo sapiens
SAMVRSQLTAVSTSAGEQESSVIHGQICSHCGHLFLPATFVPTSLPPVPIARPPTSASCHCQQVPCAGTWLRLLIHYGRSVTGAIMCSRAHSLRFRSRVARQQNNLLA

SEQ ID NO: 781923 - protein, 69 aa, Homo sapiens
ELGTPKAGISSRWALPQLGSSLRAVNSPSPPRSRSISSGRCSFFSNSHMKCTKTKGLSKDEMKECTQRT

SEQ ID NO: 781924 - protein, 51 aa, Homo sapiens
SSVPPRVTQRRTSPRIRRSPSEVPCLTGPVALPRGHLANLSRFLPQSSLEA

SEQ ID NO: 781925 - protein, 31 aa, Homo sapiens
MVAVGRAGITPTECRHVLGTLISLSHGIFLV

SEQ ID NO: 781926 - protein, 177 aa, Homo sapiens
MGKLRPRRGLRPPPSFPSEVAPEPRPGPASFHPALLCARRVLTWRGRTGDQVGVTVTDTWTVLVVFGVGSPRGRVYHSHWELSSPIKASGLKHPEQELRRVKETVTCRLQLVPAPHPVQRPKRLSLPITQHQTLPRDLSLHLLPGSIQPSSLTRSSWATGQHTGAVPSPGRGHTWLG

SEQ ID NO: 781927 - protein, 234 aa, Homo sapiens
MGKLRPRRGLRPPPSFPSEVAPEPRPGPASFHPALLCARRVLTWRGRTGDQVGVTVTDTWTVLVVFGVGSPREDINTGDSQDCWGQMWQVDVSPPPSKPSVLQRTPAECPPTPSGTADSVRSRHLHTHTHTHTHICTHMSCEGQPLELLSEWPDVEVPSVRGTLAHQDSGLVKRDQSDSILTWVGGTHQGTYKAECLVGLKIAVSSSLDTNYYFTEYRCAYGGISEQSPQTCPD

SEQ ID NO: 781928 - protein, 226 aa, Homo sapiens
MGKLRPRRGLRPPPSFPSEVAPEPRPGPASFHPALLCARRVLTWRGRTGDQVGVTVTDTWTVLVVFGVGSPRVWGPKILFSFLSPPLGFGFHDSWTRLLRDLQREGTRSGLRDTQSGLQEDTEARLKREEAGNPARGHCALGLVTGPQDSGRMGELNWQGGAHCHYGPLESRQEEINHMDIRGGRESCLEKVRGQQPAEAEPGGFGAGASVVEGHPPGSNSSHRRF

SEQ ID NO: 781929 - protein, 147 aa, Homo sapiens
MGKLRPRRGLRPPPSFPSEVAPEPRPGPASFHPALLCARRVLTWRGRTGDQVGVTVTDTWTVLVVFGVGSPRDLQREGTRSGLRDTQSGLQEDTEARLKREEAGNPARGHCALGLVTGPQDSGRMGKSVSQPLGTFFTHQSLRAEAS

SEQ ID NO: 781930 - protein, 111 aa, Homo sapiens
MIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNE

SEQ ID NO: 781931 - protein, 44 aa, Homo sapiens
MKDGTMGKLKSSGNVTVINGFNPPLPHTSSLELLTLSFLLYPPI

SEQ ID NO: 781932 - protein, 58 aa, Homo sapiens
MGGTPPTKRRINRGRRKTINTTTRKRAVNTTRKLCLAEKKIRPTERRLQQYTESVEKK

SEQ ID NO: 781933 - protein, 121 aa, Homo sapiens
HPPQETLAPSLQPSPLEQKPPGVYWGQRTANDLSQAQIIYAATNIWKWQFPANCRQFRVICQDAICPIAPGSLQRPARLQPLQTAGWQVSRQPQSLLSRSLNTSLTQNQVAGLQSWSLNPA

SEQ ID NO: 781934 - protein, 201 aa, Homo sapiens
LAPQAMQPPLAGASAATLLTTAQPPSVTLCGCAKPQEGDTHTRIGAGVGGLALPSSVPPMACSCSPAAVPAGLSPPIITHCGPVPSEPHSGYFNLHCQFFRGPSSFRIKARGCMQTLYHFLVLTLSVSLVTPQTQSQAWRPHEARAAGLGHSLTPWLASVVAWTVTGGHQGQLPCDTHALSAEKRRALVSESQHHERGARG

SEQ ID NO: 781935 - protein, 81 aa, Homo sapiens
AAAYYYYCSNSSFYRCTGTCGKEYRWLVTIKLLVVIQDTGRVSREDIWYNIIYSQWFKEDNVEEVVDLALRRSLLTDLVNR

SEQ ID NO: 781936 - protein, 38 aa, Homo sapiens
GVILGLLSLQSTLLGDLPSHGFQYHVCAEDSQISISSI

SEQ ID NO: 781937 - protein, 84 aa, Homo sapiens
LGVSQEHWEGRLGLSSAFSVPLWLEWQSHTEARGSDEATPRQPEETAPRNGQPVPCPLCLFLYPGLATPTSKGPAREAAPRPPL

SEQ ID NO: 781938 - protein, 382 aa, Homo sapiens
MRRETPPQPRKKKQNSTQEYNINTPSGESREVVENKARHTAPPPGHKIAATQTRNLTTRTTLELTRRPNTPTDNNIQPTAAPHRVQDSEHTQTDATPTPPATPRTTAGSTRNRITHDDTRHEPIDNQAAIAETNDPNQAHAKTTNAENGSKNNNTVKRNTTEGQQITRRGHDPRHKHSSITAAAQPPTLHGELTPTPARKNEHSQKDAHRDATSSSDTTQHTADTRTPDTPHDTHQPPRPTDAPRPRTDDTQHATSPTGAATQSARGRSSEGRQDGRERAEAAGAAARQTQTHGERPRTDRAGTARDDRTSRESTSKAEVAKQSARRQRTSSGHTNTDTAQHRKNTDNRRKRERERRTERQSQQADTKTTEKTRNINNEDIE

SEQ ID NO: 781939 - protein, 105 aa, Homo sapiens
SATALVPLILAVLPPMSGFWAGMVILAPRGLHLSFSRRLMQTCSYSGNRVAKEGRSLHSLLKYRPEPVKCHFCHTMLANINQRLSGEIQESWPLKRKWSTQLSSL

SEQ ID NO: 781940 - protein, 41 aa, Homo sapiens
KDSPGGDSSCQHLSTAIEYSDFFIRMLPVKVMAWNLTDLDW

SEQ ID NO: 781941 - protein, 136 aa, Homo sapiens
ENKRGKRQPSPDSCVAGPRLYGTQWTDRPSHALQSSRRFQGRKQTVNKQKARQRTCWVQTEPCSEAGEARRPPRAQTLSAQPSQPQRGGPAVPGPNMLPSQPADICTGLESIPYGSCPSWNLRMPPSLEIGSQRMS

SEQ ID NO: 781942 - protein, 116 aa, Homo sapiens
SSFYFFLNILFKQNLHESSREGKMMLLTLGEFCFPKSFSKLYNNSTNIFETIIISGFREHYCIEHCFTITLLLRRHKCFHFADETGKLRKDQLGCISCKISRWQRLYQGSRLRALT

SEQ ID NO: 781943 - protein, 210 aa, Homo sapiens
VCAVRAELPPGTRLGRARHVEAARLRLLEAKRLQGRVRGVDTRDFGGKGGRCGKDRRGRTESIGNRRDPAPMPLFCWALFEPGRERPGGPTSAPPSGALEGTAGTITSNEWSSPTSPEGSTASGGSQALDKPIDNDAEGVWSPDIEQSFQEALAIYPPCGRRKIILSDEGKMYGRNELIARYIKLRTGKTLTRKQVSSHIQVLARRKARE

SEQ ID NO: 781944 - protein, 208 aa, Homo sapiens
MAGLWRRALATCDCGERRGAGCCGGRCWPPPGAGSHCSWSVVAPRPADPATALLPSLWGHIVRGPIGPGKLGECQYGRGRYNGRKPDACPDGQRRAAITVRCESADRDTHLPVSRYAAVGGRTTGRPVAEQTGAGGNAGRSVNAPETAKSPEDPINTGDFNRPTLNGVPPEMVDNTRTRLVRCFNSGQFHNPTKPQGMDPPVGLFKFQ

SEQ ID NO: 781945 - protein, 263 aa, Homo sapiens
PNSTPESSVSSPGKSLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFYMSDEEMATITQFKKRGA

SEQ ID NO: 781946 - protein, 130 aa, Homo sapiens
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKICTVTLLP

SEQ ID NO: 781947 - protein, 169 aa, Homo sapiens
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMDVLVFLDSTVEVNRVWLEPLLHAIAKDPKMVVCALIDVLDDRTLEV

SEQ ID NO: 781948 - protein, 173 aa, Homo sapiens
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMCLQKHYPGRLPTASIVICFYNEECNALFQTMSSVTNLTPHYFLEEIILVD

SEQ ID NO: 781949 - protein, 90 aa, Homo sapiens
RGGAGDAPGWAVGSTPCLSSPRVCRSPPAEACRRRPDWGNEQAPGLEFLSGPVWGLPAEAPVPDPATSRVRWEGVAGSGRPLDARVMALA

SEQ ID NO: 781950 - protein, 115 aa, Homo sapiens
RVYAGSAQFSVEKKYSGNTFRMGRGTQPPRPAGTPGAPSPQGLAPASTSSVSFPDEARRVLSSVGVLCLIQPRDIVPGTSPPVATPGQGDGDGQGGDNSSTSNNNPGVSPKPSLH

SEQ ID NO: 781951 - protein, 43 aa, Homo sapiens
LEVAVGVKGEACSECSSECVCTEAQAVVLEAVAGLCLRACAGS

SEQ ID NO: 781952 - protein, 53 aa, Homo sapiens
SEHTHQHAKSEPCSVCNDSPSPAAQRGGDTASPLTLTTQWDPLWQGLAFINHA

SEQ ID NO: 781953 - protein, 129 aa, Homo sapiens
SSASLPASWHRPLIPEMLRANQEKKSVSQVSLSKKFFSLKNNFFSCCSSSPHFTKKGEDRQNPDPPIVFLQCPLGNDVTLVWLPPPMGEVVGDNSMGHAEHEGSLHEAGTPIHLLVPSLCLGSDAFPSC

SEQ ID NO: 781954 - protein, 205 aa, Homo sapiens
MIPIRVLMEDFQLSVKDSKPTVVSDNVFHIQWSLISFKYTSYNVSEKAGSVSVTVQRTGNLNQYAIVLCRTEQGTASSSSRVSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAIGYTVPKSAMGSSLHAH

SEQ ID NO: 781955 - protein, 39 aa, Homo sapiens
QTASSKGLVSKIYKELKQVSKKKSNNPINNWTNDINRHF

SEQ ID NO: 781956 - protein, 108 aa, Homo sapiens
VCVCVCMCVYIHNGIIFSSKRNELLIHATTWCSVKGPYVQNDPQMVKELKNQRRRQTNPICGYGMIYWGNLQTGMSYWVAAIQVDLHTTTRQTQYVLYLGESIHALEG

SEQ ID NO: 781957 - protein, 116 aa, Homo sapiens
WAPVAAQPGAAGRLLAAVSARSRPRSLETFGEACGGWEEKLSSLGTNPPAAPAPLLRLPVRPSCSLPPSPAPAPAGRLPPRVAEPGPRAPQPRPPGLSACAQVAGASRPGARGLTA

SEQ ID NO: 781958 - protein, 58 aa, Homo sapiens
MAKDHGDFIASWAFHIHEVGIGALNQAFLLVFPLLLFWRGMKEILCKRHVLVGRSSPP

SEQ ID NO: 781959 - protein, 77 aa, Homo sapiens
GGALRTPFLSPFGCLRPDPSRNFFLSDWQAKPPWRLAWTHGGRCFWGMMPIPEPGGSRLRALFGNGTLGPLRQQPSL

SEQ ID NO: 781960 - protein, 93 aa, Homo sapiens
EIHDHMEQLKELTSTVRKEHMTLEKGLHLAKEFSDKCKALTQWIAEYQEILHVPEEPKMELYEKKAQLSKYKVVCLLIDRCMQRSHRDQMGGR

SEQ ID NO: 781961 - protein, 99 aa, Homo sapiens
MRAVLTMKDTRLTAIWKLKYHVIARTALGSVTNEEPSEPVAHFLEPAQRLRPREMAQQERIPGSGRPGENELGIREVAGRILCPEPADSNPSAWSQEPH

SEQ ID NO: 781962 - protein, 283 aa, Homo sapiens
RSSSSGLTGRSDSLEFSLEEMTGKLPPISQFPPHSVPGFMIPHPPNPSCPPNTSHSRKPSHSRARESLPLLPSAKPLPPLQKYVDFSVFCPNCYPTVAHTCPPHYPTLILYLHCSSAIHYKPSICQCSSPRTLSGNSLIDHPSPPSSPTGQRLGPRTLPCDSLIRSPVPPPSPPCQRSGPRTLFCDYPVCPPTPPPSPTCKCCRPRAVSWDSSTYGLYPSSLAYFFLVPCTPSPQPPACIPNQTLWFTSLILENGFPGPGAVLEQFRMARTVDSQQSDLVDKG

SEQ ID NO: 781963 - protein, 170 aa, Homo sapiens
LWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQEEKDKKGSDCSSC

SEQ ID NO: 781964 - protein, 147 aa, Homo sapiens
MYMVTSVFRYNFELVFQVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQEEKDKKGSDCSSC

SEQ ID NO: 781965 - protein, 110 aa, Homo sapiens
IPAQDVLFSVVEEERGRDCGKIQSLMLTAPGAAPGEVCAKLELFLRLGLGKQAKACTSELPPDLLPEPSAGLPSSLHRDGPGADAEPSVDELLVFEQLIVDGRREHLQEE

SEQ ID NO: 781966 - protein, 134 aa, Homo sapiens
GGRAGIAFLRLDSAQPLGEMSSESAGAWWACHTWLVGQGRGITQIQKKPLEGSKGNAGVRSGRAHVELASGNQGHSLEAEQAGGGFQGIHAFCLCDLSKRAVGLSLPRVSQARGRAPVSSAVLVPISHQGAGGW

SEQ ID NO: 781967 - protein, 71 aa, Homo sapiens
IKWICFNHVVVPVSGLGHRVRLSNSRALAMISALCTFLYFYILPYSQSTQTLHEVQPSPEPPMINLFPQTF

SEQ ID NO: 781968 - protein, 354 aa, Homo sapiens
VTLVFPLGHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGDMKGQWQACEGLGAAAARLGQYDQALKYYKEALAQCQKEPDSVRERLVAKLADTVRTRLAQVGLVQTHTLTSAPGRLQAPGGASQAEGTPAKAGSSTAGVQHRSSSGWEDEEFEEGHQKKKEERSANVPVRAGPGRPELCFLPGTVNHSHHLASSCPTFTKHTPCRGTVLGKASIYSPGPRAHLPFVGPGPPRAEYPSILVPNGPQANRSSRWPRESLSRSRQRRPMESGICTIV

SEQ ID NO: 781969 - protein, 261 aa, Homo sapiens
VTLVFPLGHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGDMKGQWQACEGLGAAAARLGQYDQALKYYKEALAQCQKEPDSVRERLVAKLADTVRTRLAQVGLVQTHTLTSAPGRLQAPGGASQAEGTPAKAGSSTAGVQHRSSSGWEDEEFEEGHQKKKEERSANVPVRAGPGRPERELM

SEQ ID NO: 781970 - protein, 71 aa, Homo sapiens
LELAAAGGQEEDPELGACPGPGGGGGCSWSGVLGALLAATSQRSKCLRLRVPNSGSGGHGGGWGRVTCGNC

SEQ ID NO: 781971 - protein, 71 aa, Homo sapiens; identical to SEQ ID NO: 781970

SEQ ID NO: 781972 - protein, 73 aa, Homo sapiens
WSGLGPARASVWECSMLQPRVRGAGGSPAGGLTEQVPAVEDDCPPACTARALPSSPVWCLHSSPSLWQPWFRL

SEQ ID NO: 781973 - protein, 110 aa, Homo sapiens
MESTEKCEAIITHFNGKYIKTPPGVPAPSDPLLCKFADGGPKKRQNQGKFVQNGRAWPRNADMGVMALTYDPTTALQNGFYPAPYNITPNRMLAQSALSPYLSSPVSSYQ

SEQ ID NO: 781974 - protein, 88 aa, Homo sapiens
KAVMMAVIDDCYTLSPGCTATLGNFAKATFDAISKTYSYLTPDLWKETVFTKSPYQEFTDHLVKTHTRVSVQRTQAPAVAQPGEIYSR

SEQ ID NO: 781975 - protein, 184 aa, Homo sapiens
KAGRQEGWGEHWGAMERAEEPVVYQKLLPWEPSLESEEEVEEEETSEALVLNPRRHQDSSRNKAGGLPGTWVRVVAALLLLAVGCSLAVRQLQNQGRSTGSLGSVAPPPGGHSHGPGVYHHGAIISPAGAMFWGLFHDSSSGNSTALTSGPAQTLAPGLGLPAALPTLHLLHARFGRLPWPRLL

SEQ ID NO: 781976 - protein, 216 aa, Homo sapiens
KAGRQEGWGEHWGAMERAEEPVVYQKLLPWEPSLESEEEVEEEETSEALVLNPRRHQDSSRNKAGGLPGTWVRVVAALLLLAVGCSLAVRQLQNQGRSTGSLGSVAPPPGGHSHGPGVYHHGAIISPAGRELLVAGGNVVDAGVGAALCLAVVHPHATGLGAMFWGLFHDSSSGNSTALTSGPAQTLAPGLGLPAALPTLHLLHARFGRLPWPRLL

SEQ ID NO: 781977 - protein, 105 aa, Homo sapiens
MGCYVQQTTMAHIYLCNKPAHPVHVPWNLKVEEKNKIICSRFLSQNNPELPTVQDLSSTLCRIRNHLPALNHLISSKQILKHHWWQLTVLIIKLNEDVIHLGQGM

SEQ ID NO: 781978 - protein, 78 aa, Homo sapiens
LRHVLAVFHFHHLLLPIINQTASLISQVHPASEHLTTAFKARPTSAASALRACEGAYTFHAPAPTTWPPFNSSDPARL

SEQ ID NO: 781979 - protein, 80 aa, Homo sapiens
LRFHRKPVYFEYGKTQRYSDKEKYIYVYEGEHSLYGHVLSQELLICSDLPASASQSAGITGMSHHARPKDDFLNAQQDKA

SEQ ID NO: 781980 - protein, 106 aa, Homo sapiens
GEHDYFCPGFLQKKFINRMMVNSCCLLTLQMSKEWGAPSPWGRQTGRASTSNPTRTWQGAGSAPSPQDWTKARPTHQRDRTSPQSCAPRAKPLLPHCHVLRLMTSE

SEQ ID NO: 781981 - protein, 50 aa, Homo sapiens
RCYCYHSRAASRSHCLWALAPTTPSQQAWVLRLQWTTFNWKACFLPNRTS

SEQ ID NO: 781982 - protein, 65 aa, Homo sapiens
MTLSPEPDIPADDWECEMSIQERSTDQALATCKDGESRTGQGTSKKRKRQATQDETHPEARLSCA

SEQ ID NO: 781983 - protein, 78 aa, Homo sapiens
MLHAKPWLFLTPSSPPYSTCLRTDIPSRVSQLGGHQVRDSFCLVVSTERRGAISYPYTPHITDNGFHTPPHAALARAY

SEQ ID NO: 781984 - protein, 120 aa, Homo sapiens
VKQSGCHMCVHVCTQGVLCVHGHRHLCVRGYLCVYIHMGTCVYVGGVSMHVPMYNMWVPVCVCREVSGMCPERLCASLTSEGSAWAHPPGVLLMPSSLENAGLQVCSPKLSGELGGSEDI

SEQ ID NO: 781985 - protein, 90 aa, Homo sapiens
PNANSVAWNTQCEDMLCFSGGGNLNIKASIFPVHWQKLQGFVVGYNGSKIFCLHVFISAVEVPQVTGSTCPLSALARPVRPGKPGPWLVL

SEQ ID NO: 781986 - protein, 77 aa, Homo sapiens
LTQVSLPDFCLQRDCVRVVKVSLFSSFLNLDQQSHIRKNGFFGFDFSASDLEESSVIFSLPGRVTVCLCLCLLGPLL

SEQ ID NO: 781987 - protein, 56 aa, Homo sapiens
MPFTNREVFQDHTQFYDTDISSSCHSVAGPIPLCLQGPCAMWKTQVFCLCQDLLPA

SEQ ID NO: 781988 - protein, 82 aa, Homo sapiens
RARSKSSGKEPVRKSKLMHRLTRRAIGPQWPVRMWLGTQEKSSIEACAAFVGRSSILTHSCIRRQVLLSSPLILIRGFEFLD

SEQ ID NO: 781989 - protein, 109 aa, Homo sapiens
PQGLLGQAGASLFNSRQEEELGIGTPLSKALPTNDTSQQGNPLGTKRQWATTGLQKDFSPPHSWRGSGTRYLTGWEAGAASFNPKPWVFFAIRDSCRVQSAALTPPTPK

SEQ ID NO: 781990 - protein, 88 aa, Homo sapiens
MFCGPFLSKGTRNYFWVIIWSFKFRSQSPFSKMGWDPKPSGPMMSWHQPRHLPQRVQSISLHVPHVDRAVRPFTGHTPLCTAVIRAIC

SEQ ID NO: 781991 - protein, 77 aa, Homo sapiens
DGQWRLEYCVQGCWQLEFGLLIIDVKRITVCRGPGSPGADLPKGQILVVTATSLSSLLEAPFSGSAACQACGESSCC

SEQ ID NO: 781992 - protein, 152 aa, Homo sapiens
NNIPANFTRSGNKLNHQKDTRQATFLFRRGLKVQAQLNTEQLLDDVVAKRTRQWRTSTTNGGILTVSIDNPGAVQCPVTQKPRLTRTAVPSFLTKREQSDVKKVPKGVPLQFDINSVGKQTGMTLNERFGILKEQRATLTYNKGGSRFVTVG

SEQ ID NO: 781993 - protein, 117 aa, Homo sapiens [sequence omitted]

SEQ ID NO: 781994 - protein, 96 aa, Homo sapiens [sequence omitted]

SEQ ID NO: 781995 - protein, 100 aa, Homo sapiens
SVLSAAYLFVKSLNSASYLYEVMERPRHGRLAWHGTQDKTTMVTSFTNGGLLRGWLVYQHDDSETTEDDIPFVATRQGESSGDVAWEEVRGVFRVAISRE

SEQ ID NO: 781996 - protein, 73 aa, Homo sapiens
SSVKAGTGHLDVASEAIGQRQSSAAKPRRSGKESESLGPEFQGSGSGCQEEDTEGKKLSSPLEVTDLVLSLKN

SEQ ID NO: 781997 - protein, 181 aa, Homo sapiens
PPPPGSPPGPNHPLLLTQPPSPVPRAFSSLGSCPHLPAAMSNKSPRFRCNCVPCTSCTLHPSPPRAMAQLGHTISVDPCSQPSVLQLQSTPGPATLHADLPGEVWPPKKPTPSHGYTAPPIPLDPPLAAILLTPCMPPPQARSAQGSLTHVALICAQGPLSICACCAPCLECPSSSPAGVQ

SEQ ID NO: 781998 - protein, 119 aa, Homo sapiens
MLGRAGIPRQHPLPSGRPPMQRRRDARCVSALPPGAPVAGGGILHWTGAPQSGGLPQCCSRGLRVSTLCRVPSLPLPVCLHRRADLGPPFTEEGLLDLSHRDPLLCVTFSESWRDYASS

SEQ ID NO: 781999 - protein, 155 aa, Homo sapiens
DATECDIRREGWLYYKQILTKKGKAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFRVRLEECQPATENQRVP

SEQ ID NO: 782000 - protein, 146 aa, Homo sapiens
PRQLNTKDFLRTLSVQATELVLEVAVTTLTPGYPGMCPTPQSPSPGIKSFLPISSSFLQSPLSRITGSEAGLLDRWCFFFSFFPEMEFHSVWPRLECSGAVSAHCNLRLPGSSDSPASASQVAGTTGARHHTQLIFIFFRRDGVSP

SEQ ID NO: 782001 - protein, 71 aa, Homo sapiens
SRKLPALDAKIHTPSGAKGEPFGLGREAARGGVITPAQRRAGQRSPTLPIGQEDSRTKARHQLAKDWSFRS

SEQ ID NO: 782002 - protein, 122 aa, Homo sapiens [sequence omitted]

SEQ ID NO: 782003 - protein, 185 aa, Homo sapiens
MNTLFRFWSFFLRDHFNKEMYEELKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 782004 - protein, 631 aa, Homo sapiens
MNFNTILEEILIKRSQQKKKTSPLNYKERLFVLTKSMLTYYEGRAEKKYRKGFIDVSKIKCVEIVKNDDGVIPCQNKYPFQVVHDANTLYIFAPSPQSRDLWVKKLKEEIKNNNNIMIKYHPKFWTDGSYQCCRQTEKLAPGCEKYNLFESSIRKALPPAPETKKRRPPPPIPLEEEDNSEEIVVAMYDFQAAEGHDLRLERGQEYLILEKNDVHWWRARDKYGNEGYIPSNYVTGKKSNNLDQYEWYCRNMNRSKAEQLLRSEDKEGGFMVRDSSQPGLYTVSLYTKFGGEGSSGFRHYHIKETTTSPKKYYLAEKHAFGSIPEIIEYHKHNAAGLVTRLRYPVSVKGKNAPTTAGFSYEKWEINPSELTFMRELGSGLFGVVRLGKWRAQYKVAIKAIREGAMCEEDFIEEAKVMMKLTHPKLVQLYGVCTQQKPIYIVTEFMERGCLLNFLRQRQGHFSRDVLLSMCQDVCEGMEYLERNSFIHRDLAARNCLVSEAGVVKVSDFGMARYVLDDQYTSSSGAKFPVKWCPPEVFNYSRFSSKSDVWSFGVLMWEVFTEGRMPFEKYTNYEVVTMVTRGHRLYQPKLASNYVYEVMLRCWQEKPEGRPSFEDLLRTIDELVECEETFGR

SEQ ID NO: 782005 - protein, 631 aa, Homo sapiens; identical to SEQ ID NO: 782004

SEQ ID NO: 782006 - protein, 122 aa, Homo sapiens [sequence omitted]

SEQ ID NO: 782007 - protein, 361 aa, Homo sapiens [sequence omitted]

SEQ ID NO: 782008 - protein, 178 aa, Homo sapiens
MNFNTILEEILIKRSQQKKKTSPLNYKERLFVLTKSMLTYYEGRAEKKYRKGFIDVSKIKCVEIVKNDDGVIPCQNKYPFQVVHDANTLYIFAPSPQSRDLWVKKLKEGIRKALPPAPETKKRRPPPPIPLEEEDNSEEIVVAMYDFQAAEGHDLRLERGQEYLILEKNDVLIANFCS

SEQ ID NO: 782009 - protein, 76 aa, Homo sapiens
YPGRGSHTGDGDARECKGMSGARCDRRLPGTGDSSASAARVVGITGTHHHTQLIGVLGVRGVSPCWPGWSRTPGLK

SEQ ID NO: 782010 - protein, 101 aa, Homo sapiens
TGVGSGILGLCAHRERLCAPQLGHVLETPCTQSPAFSTDRALQQGSGRTRTYAEGQRPVGLQGSGGVEIWACASLSVGPSPLPTGRTSQLGKLFIQPNYVC

SEQ ID NO: 782011 - protein, 33 aa, Homo sapiens
VEGDLEWGPSNSVEPSPSTRFRRGPLPPSPSGL

SEQ ID NO: 782012 - protein, 325 aa, Homo sapiens
FFRPGSRCPAGQDVGRKGQSCPVRRSEAGAVALRAPPRLGTKIQVQGCDIVNQDSMHKSRGGIAVALTRNKKSGRQNKWEDVSGAPRVMGRYTRRQQRWQQNGMRGVAREGRTTQRSHTNTHQSDRDATKRHAQTMADNKDETHETKRCSMRRDPDAADSSRLRAAETHTSNKNIRRGQKRQDTSNGGHTLGTSEREKDSGRRTDINEATVAAGETHTSSRGEEGERPQLPHGRDQQATGASTWTPKAAVPPVTRLRNQAGMHNRRLHDERLRGPRRTHANVVPTNNYGRQTDWRQIRGSDGGPSINKRRHTRDEWGNHAIDRKR

SEQ ID NO: 782013 - protein, 30 aa, Homo sapiens
MSLCLSMITAGRMELRLQEELPSGEAGGER

SEQ ID NO: 782014 - protein, 106 aa, Homo sapiens
PLTLTGLLLLTWLKPLTPLPWGPVSVGEKALETFCLFWLAQPGALATGMVTPSPLILYPLFLWAEARIILEPFAVQSVSSVWVSHKTISFLPLKAPQGGGVHKCRL

SEQ ID NO: 782015 - protein, 158 aa, Homo sapiens
MTNTKGKRRGTRYMFSRPFRKHGVVPLATYMQIYKKGDIVDIKGMGTVRKGMPRKCYHGKTGGVYSVTQHAVGIVVNKQGKILAKRINVRIEHIKHSKSRDSFLKRMKENDQKKKEAKEKGTWVQLKHQPAPPREAHFVRTNGKEPELLEPTPYEFMP

SEQ ID NO: 782016 - protein, 68 aa, Homo sapiens
ADPRFIDPPPKTCFLNVEKSQALITSPAHEGTLGAYTLQSHRCQAARGLGSPALTPLCPGCGTGFQKG

SEQ ID NO: 782017 - protein, 58 aa, Homo sapiens
MHKHYVPPPSFPNIPLLPESSSQPCRTLALDSTFRKQCRHPVLQQWSIITKLKQGIQK

SEQ ID NO: 782018 - protein, 35 aa, Homo sapiens
TLLWEEASKMAPNDLSFLVYMPYVNPLPLDVGRHL

SEQ ID NO: 782019 - protein, 67 aa, Homo sapiens
KSWVSRGPGDPSASSGSGLGTTEGIQPKGRVPGRRLYCVDYVDGVDDVDDVQHHKRRAEAQSGALDS

SEQ ID NO: 782020 - protein, 120 aa, Homo sapiens
CHDQKKLFNIDFYCFNNIFFSVAYFIVRIRYITYKTYKIYVDQLSGFQTTVGYSSHFGRVESYTRIFDAVCVPDNRALPCCLRINWILLASFKFSIYPVTCNLLSCLPFLFLVFSIEPST

SEQ ID NO: 782021 - protein, 61 aa, Homo sapiens
MHTQTHGKTSTQTPGKTQRHTDTHMRTHPLPHLCLPALPHAGSASEPLVLPFHAGLSCPPL

SEQ ID NO: 782022 - protein, 91 aa, Homo sapiens
MHPPGVPVASQKKRRRRGDDHLKGPPLHLPGRRVECWVGSGSTLGCLLVPVTPGRSSMQPQAMASAPAQLREHFPSPHRFSCPSLSASNSC

SEQ ID NO: 782023 - protein, 172 aa, Homo sapiens
MEAAETGAFGLVVGLPLRPPRHQQNTYFFSLAALVCRSSSVQLSGCSLNAYWVPGPQRDVSHCPVLRAPTQIPSSQGPQTHPSAGLTTVWSFCLMDGVLSYATGFLGHRSDKSPGICLVAGEMKEDEKAGREGGSKGLREEGGGWRRKRNIARCSHLVAASGTHGNLEGGSL

SEQ ID NO: 782024 - protein, 143 aa, Homo sapiens
FILLCPKAYFFGKVEQFMLVYTRDGKLCLVGQIGPAACVCMACEQRKVFTYLNGWKKYLKNAIFGHKKLYEIKISMSVSFYWDTATAIPLAFVCNSCRVDYLRHVVWSPQTGTVSILAFYRKYLDPGLDKSWLVVMLCEMCTL

SEQ ID NO: 782025 - protein, 104 aa, Homo sapiens
HPFRGTGKPSAQRHPCDVIVTVRFRGGAREGGSLGCADPSQPPLQVTPAPENPHPGPQISQPHDRQTSRPGPLNAPGPGDDRPPHPLTSSASQISKPTLSRGGN

SEQ ID NO: 782026 - protein, 104 aa, Homo sapiens; identical to SEQ ID NO: 782025

SEQ ID NO: 782027 - protein, 139 aa, Homo sapiens
HPFRGTGKPSAQRHPCDVIVTVRFRGGAREGGSLGCADPSQPPLQETFGAQDMSGMRRYEVALEAEEEIYWGCFYFFPWLRMWRRERSSAHPGEQKLEPLRGLMSCLSSGLGPTPQRSGRGFPRRSPTAAAQPASALKI

SEQ ID NO: 782028 - protein, 104 aa, Homo sapiens; identical to SEQ ID NO: 782025

SEQ ID NO: 782029 - protein, 104 aa, Homo sapiens; identical to SEQ ID NO: 782025

SEQ ID NO: 782030 - protein, 37 aa, Homo sapiens
VWALKLTIMHVHAWADSLRPNQTWVRIPAPPPVNTKS

SEQ ID NO: 782031 - protein, 69 aa, Homo sapiens
VNLVRFLSISSTVYDSTCASRPHLCRGFYGEAKSLACCGFSGEDSDWQTVAPVPSSLICLLPVMNTCIL

SEQ ID NO: 782032 - protein, 112 aa, Homo sapiens
MFSIDNILAARPRCKDSVLPVAHSAAAPVVFPALHGDSLYGASGGASSDYGAFYPRPVAPGGAGLPAAVSGSRLGYNNYFYGQLHVQAAPVGPACCGAVPPLGAQQCSCVPT

SEQ ID NO: 782033 - protein, 62 aa, Homo sapiens
VGGRKCMSFTGAIIAESERDKEEGVGKKRGKGRGMEVDRLNQDMPKTFLWKYHLEEPLRLCR

SEQ ID NO: 782034 - protein, 109 aa, Homo sapiens
PARWRPQRPGTCPSRAQLGTAQQPARPRGPPPTPAPTPLAGKAIPRPRFQDIKLSSWTWSLRPSKAGSAHSDWRQQGLPTVPLHPSAGNPGQHRLPGAGGNRASKEKPH

SEQ ID NO: 782035 - protein, 32 aa, Homo sapiens
APAAACLPGPGGGGEESRPLTHPAARGSRLAW

SEQ ID NO: 782036 - protein, 121 aa, Homo sapiens
GLTLEHPSISDRSTNTFKVAPPWPPFFHQEAEAQSEKELPKAPRQFTEPLGVTLNPSNPTSLFSATTINHQGSTATGAQPGVPTGSPKAGRWGWRPCQVHGAQSCLGSLAVRAGHQAVSVG

SEQ ID NO: 782037 - protein, 67 aa, Homo sapiens
SEQAHPAWHVKEFGTAGKIKPRKQISSQQKQELSKNESSSTMKRVALLTAGLLIQEHSTAGSWAELL

SEQ ID NO: 782038 - protein, 106 aa, Homo sapiens
PHTKSTVRERCLGHTHTTLTCHTCTRTYPHVGWHPHISSPYTHTHTHTHTHTYMPMQLATRYAHKGIYPYICNPHTPIHAHTCAYMLTHAHTPATCTHTQECTLID

SEQ ID NO: 782039 - protein, 103 aa, Homo sapiens
AAPPQHVTSQIMASTDFQNLHSRCAASTEKHCVCMFQFCAMFLACHKWKHVQDKSLKTSSTHWRPCHLGKESEEGAWALPVTSRLSLAPSGIWSSQITLLHVS

SEQ ID NO: 782040 - protein, 100 aa, Homo sapiens
MCTNRAPAYRSSCGGREPCVGLLFPGLQQATPWVTSGKALSGPRWPVDKEGRPPLACLPASRGHCEVGGRPGRGATSLCGCQGTLLLLIKSKVANAFPKS

SEQ ID NO: 782041 - protein, 126 aa, Homo sapiens [sequence omitted]

SEQ ID NO: 782042 - protein, 521 aa, Homo sapiens
VSGQELQAGMAGGMSAECPEPGPGGLQGQSPGPGRQCPPPITPTSWSLPPWRAYVAAAVLCYINLLNYMNWFIIAGVLLDIQEVFQISDNHAGLLQTVFVSCLLLSAPVFGYLGDRHSRKATMSFGILLWSGAGLSSSFISPRYSWLFFLSRGIVGTGSASYSTIAPTVLGDLFVRDQRTRVLAVFYIFIPVGSGLGYVLGSAVTMLTGNWRWALRVMPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEASRRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 782043 - protein, 475 aa, Homo sapiens
VSGQELQAGMAGGMSAECPEPGPGGLQGQSPGPGRQCPPPITPTSWSLPPWRAYVAAAVLCYINLLNYMNWFIIAGVLLDIQEVFQISDNHAGLLQTVFWLFFLSRGIVGTGSASYSTIAPTVLGDLFVRDQRTRVLAVFYIFIPVGSGLGYVLGSAVTMLTGNWRWALRVMPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEASRRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 782044 - protein, 117 aa, Homo sapiens
CVCSRGALSPTAGVAGMGAAAERERGPGLTGGCLGRPWGHLVLPCGHPWLRGVPGLPTTGLWSLERRSKRHTVRPPGSSPPPLSTLDPPSSVPWTILPSTMAAPNCDPHTPMYHPLR

SEQ ID NO: 782045 - protein, 107 aa, Homo sapiens
FLPLLTGKEEGRCRKGQGVGRQGKWMTTSLPPCSSKPSSHLSMAQAFLPCLAHLPNPMLCTCWVLCLDAEGWGILLQCSAPTAPAPPVKSSPGPPRRVQCHLPLAPV

SEQ ID NO: 782046 - protein, 119 aa, Homo sapiens
MWDMPALRCQVDCGLHMAEPQKRGWGCRFRGEAVAETTGVAEIAQQMYRGGEPGLLQQSQLFPSTCKAGSLPTRKCQGQRKLAGLGTWEMRLAAPGTWLKGWAMESPAVRQPQLTRPVM

SEQ ID NO: 782047 - protein, 201 aa, Homo sapiens
GASSQDPGLREPPGRRKRPRKPSLRSFPAVYVVLRVLGQGHGDPATPQAWGKDSGVAGLLSARGVESSCRPLPPHARKAPSHGVRRRPSVNRSRGSATPSGSVGRGSLPLGRPRRVAGHGLGRPSGPRRCAGRRSQPRPRAPGGGGGGGGGDCPGRRRGAGAARRRGGRAAAEGPGRASGGRRARRGKWEARPTGAGAAQP

SEQ ID NO: 782048 - protein, 491 aa, Homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDISEEAKTLTMDILTLAHTSTEAKGLSSESSASSDGPHPVITPSRASESSASSDGPHPVITPSRASESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTNTKPHITEVTASAETLSTAGTTESAAPDATIGTPLPTNSTIEREVTAPGATTLSGALAITGNPLEETSALSVETPSYVKVSGAAPVSIEAGSAVGKTTSFAGSSASSYSPLEAALKNFTPSETLTTDIATKGPFPTSRAPLPSVPPTTTNSSRRTNSILAKTTTSAKTTMKPLLY

SEQ ID NO: 782049 - protein, 174 aa, Homo sapiens [sequence omitted]

SEQ ID NO: 782050 - protein, 106 aa, Homo sapiens
GLLGNPHWFLANSEKFFSLWKTGSTQPSSRCPVHFHHFPSRSFLAFPLVGCNPAHGGNVTPPFPSSAWPFPSSQDSTLTMETSSFPELSASVPTSPAPWLFHLLKP

SEQ ID NO: 782051 - protein, 121 aa, Homo sapiens
HKSKNSQLSAASQNFGEKHSLISLQSKEYGASKFNYQLNLLAPQSPSNTRNTVGGFQEPEKLDPVEPHQQDTVVLKVAAEKPGRALSDPREKKAGMENRPQIYPLMPQMSGPVTAARATGS

SEQ ID NO: 782052 - protein, 122 aa, Homo sapiens
MLGMEWKMARCLLRLSMPLYAIHKPLTELSVHAFERFLQERPGPKERFSCAGLCQGASAGATLGGQSPGSSSNRKDLSSLCSTCRTKHAGLPHSFPAEKHSPHPPQSPAMPGTQTSQRWGSL

SEQ ID NO: 782053 - protein, 83 aa, Homo sapiens
LTVLEVIKSKTGLTGLFGICSSLDGVDYKATIKACIPSEGSREESVLCLFQLLEAAYIPLHLATSSRFLLSASHPFPGLIDSL

SEQ ID NO: 782054 - protein, 93 aa, Homo sapiens
WWVNPGGLFHVQPALASNGLSEPICCSTLPILWALSTEADERWLPYPSWLCELSSVETITPHLQTPSLGRAIFPLLRDKKAKEIESSPQGTSL

SEQ ID NO: 782055 - protein, 276 aa, Homo sapiens
IFQIAHFHKNFPRKHQSFQLPRNTPIWEKRWLELHLKDGLYLSRVASAQGSPRDGDRELGGNATRLPGNRLRAPVRKRSEAEARASKELRFPALGPYYYLPPRLGEPRLMDRAVQFEPAQQPSIGRAGKKASYCREEASALQVPRKFRPSRLARFPCTAVLRSQASARQECLPRGRARWSGTCRQPPGTPEDAEVGPRAAASMPGWELGRPRAAAVLSQRVPWSLRTEKAEAVPRDRPRATGSGLHLDGCGPHRDGRAGPFGRYLRVASPRARPQA

SEQ ID NO: 782056 - protein, 298 aa, Homo sapiens
RAVGAPRPACECGTSFTHSDSEKPNVCPKRAAPPVGASAPQSPHFYLGPTKNREPGGLGICAPQPSPLQTEPRGGPKASNCPGLAPAETALGLTRSTAPGTPQTSALTPSNTQGALRGKWGSMPEGLLTWWHQIQSEGTRMEDGGSYPQGERGPGRRGPPLLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIGCPVLV

SEQ ID NO: 782057 - protein, 172 aa, Homo sapiens
RAVGAPRPACECGTSFTHSDSEKPNVCPKRAAPPVGASAPQSPHFYLGPTKNREPGGLGICAPQPSPLQTEPRGGPKASNCPGLAPAETALGLTRSTAPGTPQTSALTPSNTQGALRGKWGSMPEGLLTWWHQIQSEGTRMEDGGSYPQGERGPGRRGPRGEGSATLGGGGR

SEQ ID NO: 782058 - protein, 124 aa, Homo sapiens [sequence omitted]

SEQ ID NO: 782059 - protein, 231 aa, Homo sapiens
EVICENGSYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKVEELKLGKMVCIPCIVIPVLLWIYKKFLEPYIYPLVSPFVSRIWPKKAIQESNDTNK

SEQ ID NO: 782060 - protein, 55 aa, Homo sapiens
LTPHVTLLSSCLLSVMPLLITILSLNTLISIISMKCELKSSNNLTPSPQVHGTCL

SEQ ID NO: 782061 - protein, 118 aa, Homo sapiens
AQVIPPTSASHSAGITGMSQRIWPPYFQLLAQCNGSISGTANERDAQDKKQDLALSLRMEFSGPIMAHYSLKLPGSSNPTMSAFPVAGTTGWSTVAQPLLTAASTCQAQAMLLPQPPE

SEQ ID NO: 782062 - protein, 106 aa, Homo sapiens
ARNTAPGSQACPSSCPSRHEISLKPQGSQETPGSGPTHPLSDATKWREAKGLLRRCKLSAWPVLSLLRKVLRHQAPVAWGYSCTRTDSPLESCPITGRTVGSGNMK

SEQ ID NO: 782063 - protein, 110 aa, Homo sapiens
SPWGQPMGPRGGKTPGFGDLKSECGSRGMICPRAIPDGEGSSRLPGGRPGGSSRRPGWALEGILAPVSAGVMRFFCASVSRVSWVTSWVWENPGGVHILSPASWEKDIGR

SEQ ID NO: 782064 - protein, 56 aa, Homo sapiens
MAHCSLNPLGPSDLPASASQVVGTTSMCYHAWLIFYSSSSFFLRRSLTLLPRLDCC

SEQ ID NO: 782065 - protein, 34 aa, Homo sapiens
MASELKPGPDSPLLLHLWPVSPLLPLALQLSLPC

SEQ ID NO: 782066 - protein, 96 aa, Homo sapiens
SHWAIGSSRYNLREGNHMKLLLHFSGGESFKTLNDSTRKQSPGKGSVLFGGGNGDCCSGLLKCVWQGIRKDGVAEKEPQKSYRGCCRSLAKSQTMN

SEQ ID NO: 782067 - protein, 37 aa, Homo sapiens
DSSTSLMSRPNVAHFPLGIGAFQPVYLEAVVLCNICL

SEQ ID NO: 782068 - protein, 127 aa, Homo sapiens
LWPGVGAGRGCVPASEGWAGLVAVLLAGGQTGGKNFPCPRVWLSLSFLSSSLTMGFCQTSCRYSPFNNLLKKPPLERTAQASHWFPHKGHSSFRSSGLGRGQGCSGDDVGDGASFGVQQLSCSWSVL

SEQ ID NO: 782069 - protein, 34 aa, Homo sapiens
MSQEQDLLQSQYKSQTAPVSGTEVIEGSIDLNRK

SEQ ID NO: 782070 - protein, 120 aa, Homo sapiens
RDGSSAQASTWRAVSVDFACGNRIPPPWFPQDMSWGPHLAYKGQASFLDARGTFRPAQPEQLVPMPCHFCEGPRGLEEPRSPRRPSRHCLKRVLGALLGSWSPTRCGTPSCWNSTERLSC

SEQ ID NO: 782071 - protein, 120 aa, Homo sapiens; identical to SEQ ID NO: 782070

SEQ ID NO: 782072 - protein, 41 aa, Homo sapiens
MCLLGNKWGTSWTLVHKQTYKNWSQKVHEIMLKEELLLEAL

SEQ ID NO: 782073 - protein, 131 aa, Homo sapiens
HTDQSPWPNTPPGRKKMGEGSGIGSWEPHQGSSPQGTSREGSPLTTAPARFLNLACLPKQPGTSLPAQSEGLYKLWPFSAISSLEVSTEPSKDTQPEGTQASGSTHHPSPEPECQSPSSARGKGRGMRTKP

SEQ ID NO: 782074 - protein, 117 aa, Homo sapiens
LECSGSISAHCNLCLPGSSYSPASASTVAGTTGSCCHARLTFCILVETRFHHVTQARLQLLSSGNPPSLASQSAGITGVSHCTQPTTLIFYTLPFWSKFAQSASLKCVMTNTCKHIL

SEQ ID NO: 782075 - protein, 100 aa, Homo sapiens
VASTRVEASAREEGEPPAWLVDTAWAGGLDVACERQIGGKKDPCCQLPLHQAVGPGHSSGHQPLPTSPHLWTLPSSSLSLSSVLSPGLSSLTPFSPSSSP

SEQ ID NO: 782076 - protein, 32 aa, Homo sapiens
MRKLGLRSPAKAMCPGVGQGGQLAAEPISRCP

SEQ ID NO: 782077 - protein, 242 aa, Homo sapiens
MAQGERGNEEPQHKPGTEQSPHRTHRSPHTQAKVTNTERAETRRHATQQRNTTTPEHQTARPQTRRRHRRQPRHTRHNNPTETQTPNQRPPQKENNRKQQKERKENKYKQRHKNNRRDQHCTERVIDTETEREMKRQKTRQHTKARSTEEARKRRKGEKKKTEIRTKRTTTEVRQKETNVTKTKQHEQHQDTQESEATGGQAYTVRSATEDMKKEQRASGAIRPGAKAPASRRKQKKRQKKT

SEQ ID NO: 782078 - protein, 171 aa, Homo sapiens
AEESRHSMDTPSSVHAPTCPGPSGTVSLVTCVQTQRQVALWEGSVSGLSPVFRHSVRSPCRKAASLGCHLCSDTASGRLAGRQRLWAVTCFQTQRQVIPEPHTCTWAAAPLGGPSLPMGTLCGALSWAWLLPEKCLPPSESACVHKAQKNRRPQWLPRKLRVSSASAPELR

SEQ ID NO: 782079 - protein, 136 aa, Homo sapiens
AYPKYTFHDREEVVKANIRDPLQIIKIIRENEHLGFLYMIPAVPRSSIEYDTYNLKVVSYENINKNDYYTISQRAVTHIYNEDIEFIEIDRWEQEYLYHRELTKIPIFSLFRKWKAFSVWRKNVRSKKITGCQKSL

SEQ ID NO: 782080 - protein, 102 aa, Homo sapiens [sequence omitted]

SEQ ID NO: 782081 - protein, 81 aa, Homo sapiens
LVCMMSTRTHSTCAHTAHAHTHADTAHTAHVHTACVHTHSTCTHSTYTAHVRTQHMRMLTQHVRTNSTYIAHTHMQHMHTH

SEQ ID NO: 782082 - protein, 170 aa, Homo sapiens
MDGESEVDFSSNSITPLWRRRSIPQPHQLLGRSKPRPQSYQSPNGLLITDFPVEDGGTLSAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPV

SEQ ID NO: 782083 - protein, 107 aa, Homo sapiens
FCPLTSPCLPVFFLGAVRCWEEESSWACAGVPAAFLSPDVLAQRQEPCAWHCTCPSLPIWENQPSLLAFHSAESPPGYCEHIPGAPHIGQEGPQACGSHTIIKAEAC

SEQ ID NO: 782084 - protein, 145 aa, Homo sapiens
MVTKVRLNSHMQLQAPSTLHSTSIWLQEPLSSHRRPHAGWICSLHSHSNSRIQLPARALRLKPYNVWHSMALPLGAQVDKSRGPSKASQAQKHRAHICCQGSEFNSQTEVAGGNVQRAQTATHKTGKREGCQVTGEPANNGQLKN

SEQ ID NO: 782085 - protein, 40 aa, Homo sapiens
MFVTAEGRVRADDPCKCTAGLWLENRGLGWGRGHEAAFVY

SEQ ID NO: 782086 - protein, 138 aa, Homo sapiens [sequence omitted]

SEQ ID NO: 782087 - protein, 104 aa, Homo sapiens
MLGMKRKEGTGGARWRRQMRRRGHRTEEEKAPERLGIREHIYIFEGETRGETNRTYLSPKEEMVFQEESPNEDCRFPVGIFPHRASGSVTGLGRVCVCVCVCVC

SEQ ID NO: 782088 - protein, 76 aa, Homo sapiens
TVMFGAGFQQVHVRRSQTVPLPTPHPQSGFSELHPLADSAQHAPQAGTDLPWDCKDISTSFSFVPSGLIPLQSSKD

SEQ ID NO: 782089 - protein, 111 aa, Homo sapiens
MLNIFHVLIGHRCIFFCKVSVPIFCPLKKVDCPIKLKSFCTAKETTIRVNRQSTEWKKIFAIYPSDKGRISRIYKELKQIYKKKTNNPIKKQTKNMNRHFSKEDIYAANRH

SEQ ID NO: 782090 - protein, 322 aa, Homo sapiens
RRVCSAEGAGSPGPALDPRWLPTEAHLLEAHRLLLQSVLCDRPRESIQLHFRLSMASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVF

SEQ ID NO: 782091 - protein, 355 aa, Homo sapiens
METEAQGGLECNGKISAHCNLRLPGSSDSPASASRVAGTTGDGITLALTCGGSGTLNQQTTEYSTSDVRPSFIYGVFLLLQLVQLDVREITRGIFNTCVDLRRIIRTLVRRPSQEPAPPGLETNCHRVTDLSYLHAVSSSAHVQHAFQKTKIYTYQLNVGIKCSSAFHFTQDSIQSPSQGCPGCFPKLLRAISSWLLALLGPLDAPGSKPGPRRTQPWTVPGPSTWSLPSVSIPKVHLRRETYLDPWVKLRLPEVDPDSSPVSPSNANSICMPFERRTKPGAALKSPEARLHNSSGNGHKAAQPTRRANTRTATADWRTNGQGTRVSRQPMCKHATQTHDKTQQDSINDHATRTT

SEQ ID NO: 782092 - protein, 71 aa, Homo sapiens
SPRRWLIGLQTHNGQDFSLHLPLKPELHLPHLTKCTTSHLCTQVGILEHHLQHSISHSCHNQFSNSLASLS

SEQ ID NO: 782093 - protein, 151 aa, Homo sapiens
QLAILSLHHSQTLKGNKVKTKKLHPKDKGQQHQKIKEHLPSQMRRNQHKNSDNSKTQSVFLPPNDLTSSPAMVVNQIKAAEMTEFRIWMVRKLNEIQEKVETQSRENSKMIQELKDDTAILRKNQTELLELKNLLREFHNTTRSINNNRSI

SEQ ID NO: 782094 - protein, 71 aa, Homo sapiens
RQGLWEALLTHNMVAGCRLEEVDNAYGHYEAFSTLAPKAWLSVELAEPCVPEPGLPPVFANFIQLLSAQWW

SEQ ID NO: 782095 - protein, 105 aa, Homo sapiens
MSGALDVLQMKEDVLKFLAAGTHLRGANLDFQMEQYIYKRKSDVIYIINLKRTWEKLLLAARAIVAIENPADVSVISSRNTGQRAKLTFAAATGATPIAGRFTPE

SEQ ID NO: 782096 - protein, 593 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 782097 - protein, 593 aa, Homo sapiens; identical to SEQ ID NO: 782096

SEQ ID NO: 782098 - protein, 573 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGAGTVSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 782099 - protein, 575 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGAGTVSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKTMGSSTAPAQAWTRRPLGLSGHLPCYRKSGRQSCDQALGAGPADIVDGQMDQKMGG

SEQ ID NO: 782100 - protein, 593 aa, Homo sapiens; identical to SEQ ID NO: 782096

SEQ ID NO: 782101 - protein, 542 aa, Homo sapiens
MTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGAGDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 782102 - protein, 521 aa, Homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGAGTVSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQRWGLDLLT

SEQ ID NO: 782103 - protein, 109 aa, Homo sapiens
KVLASGSLGTSTGTSPALITLQRSHPVLPSRDTGRVGHRLLGCCLLRGLCLLLSLLWGLGVLHWKRAKPLVHVGTREEAALERRPPEGRQRSRPCLQGPRPAWLSPSAS

SEQ ID NO: 782104 - protein, 160 aa, Homo sapiens
MASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWG

SEQ ID NO: 782105 - protein, 35 aa, Homo sapiens
MQKVLWIFKSQLSVQACSTELSVLMARLAVFPLVN

SEQ ID NO: 782106 - protein, 198 aa, Homo sapiens
TLSCSGRGSDTRIQVVCVPRSLTPRSKQQASRSADSLRGPSPVLRAARAEWKLLCSSGAPRAAVPAPPQGGPRAEEILDFRSEFFTPSGFFPRLRVCFSSLPPQDTVRPPPLAPPRSLHHAPFALPPDLIFGFAGSPLSGRGLSSPARNRAEGGAAGRPEASGRGLESPGCFFFFGDGVSLLLLRLECNGAIPESPSS

SEQ ID NO: 782107 - protein, 174 aa, Homo sapiens
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGKQGHR

SEQ ID NO: 782108 - protein, 84 aa, Homo sapiens
FLWLQVLEGSQSTEVGAAHPPAVFCNTGIHFEPTAAPAGRASCQMLSGLARLFESVVMASSVECRPKAIACQLKSVCHVVMPAV

SEQ ID NO: 782109 - protein, 132 aa, Homo sapiens
RRALIHTETLVHTQTCTDTHRDARAHAHRRALIHIERSCTRTQTCTDPQRRSCTRTQTCTDPHRDACAHAHRRALTHRDARAHAHRRALIHIERSCTRTQTCTDPHRDARAHAHRRALIHTETLGHTHTDVH

SEQ ID NO: 782110 - protein, 34 aa, Homo sapiens
SALCELFDPSIHVVGSSHKDNESSLSTDGAVGWE

SEQ ID NO: 782111 - protein, 43 aa, Homo sapiens
RVRAGQAPDPAQPSLRFVCLLVWGLTQAQRQTGHKHRHRQSSL

SEQ ID NO: 782112 - protein, 121 aa, Homo sapiens
PQPATTLTWRPSMGLLASFNCCPLPLHPPQSRSVLFLNLKKDHAAALLKPFTFIESYCPSNKTASPCLSSISSSHTSFSNLRQGALPSLAAILPCWSDFSLSNIPDIPLLLAVFAPALSST

SEQ ID NO: 782113 - protein, 74 aa, Homo sapiens
DMTTRFERAVPLTLHVHNSTIHNSQRVERTQLSIYKSINKMGSIQPVEYYSALKRKDNPIHSTTTWMYLEDMKL

SEQ ID NO: 782114 - protein, 216 aa, Homo sapiens
CTLRCTPAHLSPLPSPGCNFAQICPLAVLHILPLLLAGEARSNTLCSPRTRCISFLTLHASFSASCCLHTFPLPGPSFTHSISHLLLPARSGPLLQTHLGHIFPPPHRLHAHHSFSGVPCSLLSPCTLAILCTPPDTLLPPFSYVEALSLLILKNPRFFHSPTLPSHHDTPSPPPPAFPLAPFAPSLLVTPFAHLPPRNCFSHTCSFSSSLPGSHS

SEQ ID NO: 782115 - protein, 88 aa, Homo sapiens
MAFPCLPGSYQPKVAGQLVVPSGEGHPNVHGLVSAPVQSQVQLLAPSPPNHTRSRIQSRVQLLALSPPNHTRPRIQSRVQLLALSPPN

SEQ ID NO: 782116 - protein, 67 aa, Homo sapiens
KGSPEIKPPWGNPQNSERLKAGNPNKAALSLQEIPSTKDLAPNENERNFGLSSWQECLELAFLKSLG

SEQ ID NO: 782117 - protein, 132 aa, Homo sapiens
MGGVRMLGWFHPPISQPGGWTSYLAPRASVPREASRSCVAFPDLAKGITQHHFYGGSHQRLPGFKGKVRRYPLQMGRVSKNLWMFFRTATYLLGVLELTVDSCEVCLQHRENLVNVSTSLSWDLRHRLHRKL

SEQ ID NO: 782118 - protein, 53 aa, Homo sapiens
MSQIISLPTVLQRLPVSLRVKAKCKVQAVPVGPPSSLLLAAYHTSLQHPPHSL

SEQ ID NO: 782119 - protein, 103 aa, Homo sapiens
MNCRLSSFSTPAGTWGRLGLLTRILEGEREYLWQHHWQSPAVHWDSSPHSPPFRNRLHGSRRESLQIQGCHQLTVRAHLGTPGPTSEAAPYSGQRSGVCQASF

SEQ ID NO: 782120 - protein, 113 aa, Homo sapiens
EQTCRALRGSAGTTRSTGTRVPRVPSTENGDLLFCKGFSSLVLTHFCRLEGRQDGYGSGRGGGGCVFREAPLSGTRTPVLGQAGALTSGASFGSKNRVEAKVVEPGTLPAVCL

SEQ ID NO: 782121 - protein, 466 aa, Homo sapiens
MNLLHCHWAQEMGALLGAPSPGRGRGRCCYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPSLPGPPPGPLWCLSPPQHCPVDPRSPAAWSDPGLRVPPAARAHLDNSSLGMSQPRRRTLGDGSTDHTHPRRHHKKAQKRPATKPPATHEDHTKERKGSRQKTTKERKERQKQEPPPKPGTRTQDKNTGPTGARQKPRKNGNNHKGQQTPDTKPAHQPTTTHKKTNQATQRQEPNKTTRQTKPKQDTTPDTNQSNTEPGQGTGQSDTRRRGRRRHAGAPQPATASRERPARDQGRGRTQTGRDESTREDQRSTSHADRRRQKTEKEREKDEADAKTKGRHRKRPGGA

SEQ ID NO: 782122 - protein, 80 aa, Homo sapiens
PGLISDFDFSGSILGAPSQLMPPSVLLLPAIEQLHCSRHYLLFYSHGNPHTKACVAFTVGVEGGPTLRGSPSLSLRSELH

SEQ ID NO: 782123 - protein, 54 aa, Homo sapiens
QEPVHTRARALAFQEWELSLELLRIEALCAEGKSSATLVPWLLCPKDKEVSQPG

SEQ ID NO: 782124 - protein, 51 aa, Homo sapiens
MVLCYHPRVTDGETEAQRLCNCPARLLPYLLPPPAPSFRPGCVLSPLVPPA

SEQ ID NO: 782125 - protein, 100 aa, Homo sapiens
FPPRSGRNNSFPPSSQITLQDGLNSYAHSHTYMHIHTYTHAHTCSLMHTHTHSHSHPHISSHAHTHAHSHMPSHTHMCSHLCTLTPTHTPQSHALTCSIS

SEQ ID NO: 782126 - protein, 71 aa, Homo sapiens
DFVELTFISVAPHKLSSHSTEPTVSSRSISELSVLWRTPCGSFCHIPLPFDIQTTSLFFALISIGVGGDCF

SEQ ID NO: 782127 - protein, 64 aa, Homo sapiens
MGSRSHSGRGRGCQGPNYTSSYGTNSKLSNPSEIESEGKDKLSDWSLKKMIETADISVTAGDAQ

SEQ ID NO: 782128 - protein, 100 aa, Homo sapiens
LIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTA

SEQ ID NO: 782129 - protein, 139 aa, Homo sapiens
LIAKVIQNLANFSKFTSKEDFLGFMNEFLELEWGSMQQFLYEISNLDTLTNSSSFEGYIDLGRELSTLHALLWEVLPQLSKVSRSPLCPIPRWLQRFLEPEKLPFEDFFSPLVSRGVTTTIPTQAPSTCTLRGPLRAGH

SEQ ID NO: 782130 - protein, 58 aa, Homo sapiens
MPNHFSIMAHMDGDNTVFVGTLKIKEKNGCCLRPPGQDCWQPQATLDVQERGIYFTGS

SEQ ID NO: 782131 - protein, 66 aa, Homo sapiens
SSSLGLALTQAGQIQLLVLQTNRAVLRPQTLARAFCAEGPCEQCLLFKVHSQPENFFLLACLQFMK

SEQ ID NO: 782132 - protein, 120 aa, Homo sapiens
GTDILSSFWLQVAQRGLWWPSEGTCSLLDPKNTATPVMTWEGKGLGREGHLRSLGPLSSIPFSISCFMMSVPGGGLFVDECGFLEALGHTLTWEVGLKPVPHGPEEGVELLADTGKAMKT

SEQ ID NO: 782133 - protein, 93 aa, Homo sapiens
MQKGNVLLMFGLLLHLEAATNSNETSTSANTGSSVISSGASTATNSGSSVTSSGVSTATISGSSVTSNGVSIVTNSEFHTTSSGISTATNSEF

SEQ ID NO: 782134 - protein, 85 aa, Homo sapiens [sequence omitted]

SEQ ID NO: 782135 - protein, 68 aa, Homo sapiens
LRSVDIVKPFILRNIIYVEKTKAQWLSTVLGYGIFHCYMEYSRLRGEAGSDVSLVDLGFQTGVLHVAV

SEQ ID NO: 782136 - protein, 273 aa, Homo sapiens
SFFPHFLGCGQAFLRQGPWPPPRRVTQASAIRPLPGWGTQAATRPSKGWPASRASLAPRPAPPSAFPAACRVLPFPYIAGAGRGPGAGWSAMGVATAAAAVAWGQSRGPEPGRGLQVISWGECEQSSPPLGGCGWQGAQGVLASHPPPWAPASGRSWVGGGWRGCWAETLGSPGLLPCLAPSHARPLAFPREEVAGRVVVGTPAALGKPPRALPAKAVLGQGGRGPGRLGRRVGASPCPPPCLPPHGPQAEKVTPATASGEESREGELGGGRF

SEQ ID NO: 782137 - protein, 281 aa, Homo sapiens
YGSGMRPPPNSLGPPCPGLTWARELADPGPILTVLTQFHTPTPINLYAFFLKKKTTGKTEKKKNKKKKTLLLWAPPWAPPREEPSQEPCAGRGRAREAPQVSGKNAKPAWAQQHRASPRGNTPAGHTRAQLRRACEELSPTVESKKKHPPRGRSTTHDPVSSWHTPNSPHYASNFLEKRLLLPGDLSISSTRGDSPQDAPANLIQQPTSPQAPGGPPPRTRHATQHRSIPTHTVRHHKGRHAPTHKRPTRKHHNTTTTAPTRHTHTDRGTKHQARRGPPHA

SEQ ID NO: 782138 - protein, 113 aa, Homo sapiens
GPFPAHVGCFLPAAFFESHEVHFSAPCKCCILKWSRRPLGSSKGPCWPRALNTFGSRLSIEGLGCWRIRPTLFMGSWPLSGPRPHVRGHGPGSPMSMCKGGTLWLCCRPHSVT

SEQ ID NO: 782139 - protein, 173 aa, Homo sapiens
MPSSLFADLERNGSGGGGGGSSGGGETLDDQRALQLALDQLSLLGLDSDEGASLYDSEPRKKSVNMTECVPVPSSEHVAEIVGRQGCKIKALRAKTNTYIKTPVRGEEPVFVVTGRKEDVAMARREIISAAEPLLHDPRPPANKNPALNGAVPGPPNLPGQTTIQVRVPYRVV

SEQ ID NO: 782140 - protein, 48 aa, Homo sapiens
PPLRRELAGVRGCDWRSADSCPQYRGHVGFGRGAAAPGPASRTWTRDS

SEQ ID NO: 782141 - protein, 104 aa, Homo sapiens
IFQVPEVPQEAAEKEIPVAPPKKPEAPIVPVPEAQEVVPEKKVPKAPPTKPEAPPATVPEVPQEIVPEKKTLVLPKKPEVPPVTVPEAPKEVVLEKKVPLAPPK

SEQ ID NO: 782142 - protein, 46 aa, Homo sapiens
MHVCRDGVTAAASQSGRRVSQIEPRSQIEPRSQIEPRSQIEPRSEI

SEQ ID NO: 782143 - protein, 83 aa, Homo sapiens
LHRSPLTHERAGPNRCSFPRGPPSSSAGALPARVGVAGPPRLLPSYRHGPAALLCGSGPCDVTRKGFPFQQEGGIHTWSSLIR

SEQ ID NO: 782144 - protein, 51 aa, Homo sapiens
PEATHVVVWAVTPEGYSAGETSSASHHRETASRWLVVPKQDSVERKTRDGV

SEQ ID NO: 782145 - protein, 70 aa, Homo sapiens
SYFPIACQLGIQQNGAEAVPLTPTSALNVNSYSIVYRTGKDYPGPSTSFTPSPRIPSSAPLKGHDRKLYL

SEQ ID NO: 782146 - protein, 549 aa, Homo sapiens
MLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 782147 - protein, 454 aa, Homo sapiens
GTCLYDSRCRGQGVQPGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 782148 - protein, 333 aa, Homo sapiens [sequence omitted]

SEQ ID NO: 782149 - protein, 238 aa, Homo sapiens
ERRYPVYHPIPPYTTRLYHQQNKLLEKIYLIKRNRGDRKCKATDYFCWYLGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 782150 - protein, 549 aa, Homo sapiens; identical to SEQ ID NO: 782146

SEQ ID NO: 782151 - protein, 458 aa, Homo sapiens
MLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQVRILTAHWPPVPVCFFQRVAPSSLQEWFM

SEQ ID NO: 782152 - protein, 458 aa, Homo sapiens; identical to SEQ ID NO: 782151

SEQ ID NO: 782153 - protein, 214 aa, Homo sapiens
MLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQAINTGTSSNRHMANC

SEQ ID NO: 782154 - protein, 545 aa, Homo sapiens
NRAGAQGSLLVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 782155 - protein, 333 aa, Homo sapiens [sequence omitted]

SEQ ID NO: 782156 - protein, 549 aa, Homo sapiens; identical to SEQ ID NO: 782146

SEQ ID NO: 782157 - protein, 549 aa, Homo sapiens; identical to SEQ ID NO: 782146

SEQ ID NO: 782158 - protein, 273 aa, Homo sapiens
MLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVTWSAVQQSEAG

SEQ ID NO: 782159 - protein, 191 aa, Homo sapiens
MTFFTELEKTTLKFIWNQKRVHIAKSILSQKNKAGGITLPDFKLYYKATVTKTAWYWYQNRDIDQWNRTEPSEIMPHIYNHLIFDKPDKNKKWGKDSLFNKWCWENWLAICRKLKLDPFLTPYTKINSRWIKDLNVRPKTIKTLEENLGNTIQDIGMGKDFMSKTPKAMATKAKIDKWDLMKLKSFCTAKE

SEQ ID NO: 782160 - protein, 61 aa, Homo sapiens
MGFHCGECPAGPLQAFPRRQPALCRRQKKIEALTEQMVRRKPGGLRWASEDTRRAGGMETA

SEQ ID NO: 782161 - protein, 113 aa, Homo sapiens [sequence omitted]

SEQ ID NO: 782162 - protein, 50 aa, Homo sapiens
LSPLLTPLFLLFWFRPRALEIIDFFHHFTVDVAGVGDICSFALMDVKRHG

SEQ ID NO: 782163 - protein, 70 aa, Homo sapiens
WMHGSGLRKQRRHQRYAVNTKEALRSKESRVFWAAHRVTVISQMRPTDPAHTQRHRRRITLPNKGSSPLS

SEQ ID NO: 782164 - protein, 79 aa, Homo sapiens
DLEDPSQAGRHRECPQNGRTENGNCSSSPTSSSSFLAAPPPLLRLVLSSFFSFLCPSSFLLQQQGSEGKESITGLDTIP

SEQ ID NO: 782165 - protein, 159 aa, Homo sapiens
MSRSFYVDSLIIKDTSRPAPSLPEPHPGPDFFIPLGMPPPLVMSVSGPGCPSRKSGAFCVCPLCVTSHLHSSRGSVGAGSGGAGAGVTGAGGSGVAGAAGALPLLKSQFSSAPGDAQFCPRVNHAHHHHHPPQHHHHHHQPQQPGSAAAAAAAAAAATA

SEQ ID NO: 782166 - protein, 41 aa, Homo sapiens
MWASETSAGAVTEQRGASQSPEVPQQTEVGDKKLEEDTHPH

SEQ ID NO: 782167 - protein, 90 aa, Homo sapiens
KRRNNNCAKKSRGHVQPIRCTNCALCVPKDKPIKKFVSRNIVETAAVRDISEASVFDVYVLPELYVKLRYCVSCAIHSKVVRNRSHEARK

SEQ ID NO: 782168 - protein, 201 aa, Homo sapiens
RATLVVYPSIRIHRSIHPSMHPSVHPSSHPSIHLCVPIYPFIHPSTHPSIHPYISPSIIHPSTHPSIHLAIHPSILLSMHPYMHLSIYPFIHPPIRPPVSPSGPTSPCRAAAVSVELGVERGMSRGASWAVPGRGKGGSSFLAVGMPGVSGKGEEFIILRTERFIDGAVGEKDRQVVRGYTCRASWGAVRSLVSISCSGDP

SEQ ID NO: 782169 - protein, 103 aa, Homo sapiens
TEHCQISVTRRGIMGAPASSLPTPASASAQASSPHLGLPALSALPAKPSNADGKMAPSVSPPFVPSSCTGAQVTSQGDTGEDPGYKEPQDKQINTSTFPRHLC

SEQ ID NO: 782170 - protein, 61 aa, Homo sapiens
MWALLCPRELHLWLAGAVRWAPAVSLQALNLDVSALRKNAQELLQNRCKIETGMMLQQGSR

SEQ ID NO: 782171 - protein, 116 aa, Homo sapiens
MPSSTEIVHLENSSFDFSVISMLRWIFTKSMIIPSGGKLLIKQLLRIFWSESFWNHEYFMFSRAPLSDTSRREPFKVLRQCSYYFPAGGSDCSALHNFAQVPVYMFRAIRYEAKQL

SEQ ID NO: 782172 - protein, 34 aa, Homo sapiens
SAFTVMGCDGEEQVLGGSNSPRRTQRSVLPESIK

SEQ ID NO: 782173 - protein, 65 aa, Homo sapiens [sequence omitted]

SEQ ID NO: 782174 - protein, 70 aa, Homo sapiens
VQIVTRLDLTTRLDYYAARSDYAAVGGAELAGWSELALQQGRLTPQQALWGQMQLPSARWECGRGLERLA

SEQ ID NO: 782175 - protein, 205 aa, Homo sapiens
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 782176 - protein, 205 aa, Homo sapiens; identical to SEQ ID NO: 782175

SEQ ID NO: 782177 - protein, 200 aa, Homo sapiens
GVLRSIWDPNDGLSSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 782178 - protein, 108 aa, Homo sapiens
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKKKATI

SEQ ID NO: 782179 - protein, 179 aa, Homo sapiens
MAASTASHRPIKGILKNKTSTTSSMVASAEQPRGNVDEELSKKSQKWDEMNILATYHPADKDYGLMKIDEPSTPYHRLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 782180 - protein, 187 aa, Homo sapiens
MAASTASHRPIKGILKNKTSTTSSMVASAEQPRGNVDEELSKKSQKWDEMNILATYHPADKDYGLMACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 782181 - protein, 198 aa, Homo sapiens
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGFISSAQH

SEQ ID NO: 782182 - protein, 113 aa, Homo sapiens
CLRVSAVPTLLFADPTPSSDPEPTAGAPGNGGLDGLAPAHQGDLEEQDLYDFLYGGVGRTAPRECRRGAEVSAGRDGLGAPPSRRARYLPRPQGRAGGVDAARVPLESLLLPG

SEQ ID NO: 782183 - protein, 205 aa, Homo sapiens; identical to SEQ ID NO: 782175

SEQ ID NO: 782184 - protein, 205 aa, Homo sapiens; identical to SEQ ID NO: 782175

SEQ ID NO: 782185 - protein, 205 aa, Homo sapiens; identical to SEQ ID NO: 782175

SEQ ID NO: 782186 - protein, 185 aa, Homo sapiens
MNQALLTIGIYFKNLKKKKRYKIWLCCPVQWLLTGTVIAHYSLELPTQVILPPPPPSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 782187 - protein, 128 aa, Homo sapiens [sequence omitted]

SEQ ID NO: 782188 - protein, 78 aa, Homo sapiens
RNEMGVKLEIFRMIIYLTFPVAMFWVSNQAEWFEDDVIQRKRELWPPEKLQELEEFKERLRKRKRREEKLLRDAQQNS

SEQ ID NO: 782189 - protein, 71 aa, Homo sapiens
RNEMGVKLEIFRMIIYLTFPVAMFWVSNQAEWFEDDVIQRKRELWPPEKVSDLSSLPEGWRSWILVSGMGL

SEQ ID NO: 782190 - protein, 86 aa, Homo sapiens
MGSQGNILIHGLQRFMGEAWFPRRSGTISHHFPWLKLEVHLAPHHSQVGCCPTLLCFILCGWSKLPSQFQCENRGISVEGVEFIHP

SEQ ID NO: 782191 - protein, 33 aa, Homo sapiens
MEASQTLCSDLWGLDPSAVKARKRQGRMVPGGS

SEQ ID NO: 782192 - protein, 77 aa, Homo sapiens
YTGYYFGAPPAPATVWWVGRARRWFPAQLTLRDWELSMQLIACLHVVSELTWLCSSSAFHYDGCPVFILTVFVIVVK

SEQ ID NO: 782193 - protein, 52 aa, Homo sapiens
WGGDEFWEGSFLPGYPQSPQGRVAIQSRSECSVSWSLLSSFLRKRKQDPCVG

SEQ ID NO: 782194 - protein, 38 aa, Homo sapiens
MLTAATVSGKGRYVCHPYSTQTLRTLPKKDLSQGSQHS

SEQ ID NO: 782195 - protein, 138 aa, Homo sapiens
YPFPLLCNRQKERGAYPSRLVVRATPSQCSLLSERPCDWKSSSFSFSPSLSISVAETFLLLPHSRQQGFHFYHTESGMRPHGPLSSLEDSLGVLLGTAASWLMRGCSKSGIPADLKIWCEIAPRTGQPRNILQDGVYL

SEQ ID NO: 782196 - protein, 86 aa, Homo sapiens
SSNPTPIVTIKTVHRHCLASPSGGVKSPMAEKPCSRGNVHTPTHPGQGGASGVTGKGHNLALGLAGGGCISAVALFLGLSAELLWM

SEQ ID NO: 782197 - protein, 94 aa, Homo sapiens
AKALIIPLLFCNGQRSKASRRGESTDEQNGSKKEQRPNGQRGGRRRTKAGQMCSTPAPPPGPLQGQLDDLNSGLSSWRSPTLLMPIPFCLHETL

SEQ ID NO: 782198 - protein, 81 aa, Homo sapiens
CCVSLEGARACKRLVKQCSCFLYLVKIKKEYAHVCWYAHLDVTFCSVELVIASPDLDLSLLIPNPSPVPLHLWGGPCDPGI

SEQ ID NO: 782199 - protein, 69 aa, Homo sapiens
TFQKRDSEVVGSVCQEPLSKALVSLCGPSSDTSPSYTGSGIIKHLIVLWIHQLLKVLLLLEKPSLPLFT

SEQ ID NO: 782200 - protein, 251 aa, Homo sapiens
LLALPKMLKGKKAKGKKVAPVVKKQEAKEVVNPLFEKRPKNFGIGQDIQPKRDLTCFVKWPCYIRLQRQGAILYKWLKVPPAINQFTQALDRQTATQLLKLAHKYRPETKQEKKQRPLAQAEKRAAGKGDVPTKRPPVLRAGVNTITTLVENKKAQLVVIAHDVDPIELVVFLPALCHKMGVPYCIIKEKARLGRLVHRKTCTTVAFTQVNSEDKGALAKLVEAIRTDYNDRYNDIHCHWGGNVLGPKSVA

SEQ ID NO: 782201 - protein, 77 aa, Homo sapiens
DAHPSMPAFHESRVPAGAQCAHIYVYVLPPLWVCMRAWARSAVCSTGLKQAAPLCVGIRAEEDVLLPAGASPALRGY

SEQ ID NO: 782202 - protein, 119 aa, Homo sapiens
MVAADQGRGWNPLDGPTWEVLAMPLPLGPATQVPALFSAALVPPVSSLRPNQMLDWQRLKTPHGAPVACSLGLSGEWVPTPCALSILALLGLQLDPLFGLWGCTRTLFWSEWARESRRP

SEQ ID NO: 782203 - protein, 37 aa, Homo sapiens
MGSGGQADVSKEVVQGRLAVCRTQGQWYKVQMKSAWK

SEQ ID NO: 782204 - protein, 106 aa, Homo sapiens
MATGKARRPVSCPRHSACSCGRECGHLESWRVLQPTSRQVSSLTWEAEGTRLSKGRGILTRPEVPPTPTPSVHTHLRATWLSPAAVKGPQSSLARSSYLHALIIEG

SEQ ID NO: 782205 - protein, 72 aa, Homo sapiens
GLLKCWEPSCAAAGGGHRDRPSGEALGFLCLERPLLCVQQTKTSSAAPRRSPYRNVHCPVVIKLEPETSKKP

SEQ ID NO: 782206 - protein, 86 aa, Homo sapiens
FGCSCLSYLFSVLKNQLDLAVINRRGTRNSRGRETQGKVGEAGLINSKNLPKKFERAGRCGSACNPSTLGGRGGRITRSGDRDHPG

SEQ ID NO: 782207 - protein, 113 aa, Homo sapiens [sequence omitted]

SEQ ID NO: 782208 - protein, 83 aa, Homo sapiens
DIYMIGVSLGAHISGFGEMYDGWLGRITGFQYFKCDHQRSVYLYLSSLRESCTITAYPCDSYQDYRNGKCVSCGTSQKESCPL

SEQ ID NO: 782209 - protein, 77 aa, Homo sapiens
LKAPSLIPHSLTLVAIALELYSYATALNVYSWDLCAYCLQYWKQGKSLQHFPLSGLDLQESLTDLNSSAPFTADVAF

SEQ ID NO: 782210 - protein, 169 aa, Homo sapiens
MFQDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHT

SEQ ID NO: 782211 - protein, 102 aa, Homo sapiens
RTSSHASSHAETYTSHVLARVIARTNTHINRREIFQINNLTLQLGAEEDKELKKEAFPNERQEISIFTSEQLQGQVLVQVPGVENEPFKRMAGDGKSEEEKQ

SEQ ID NO: 782212 - protein, 80 aa, Homo sapiens
GDGSPAHILPSSRPTSPSRPGSRKPRQRPSPQLPSELGRRCLQLWEAAGAHLGTTCGGTRKHAPTSRRTFQKYPWESGLP

SEQ ID NO: 782213 - protein, 379 aa, Homo sapiens
GPRGGSRGGRRPRASRSPGGPGLHPGGLGAMESWYSLMAHYDEFQEVKYVSHCGAGGACGDFLPAGHRAQAGLQLWKRRKLNLLSGWCLQPASAPSWRLCWCSSTWARSRPAAEPVLKAVLSARLRVHRSLLGRQPGRQHRPMPGLILVRLRRLAAAPCHPRRQAHLRHHRGHRLAERGAPAAPAGSAQGWTRRRCPALGALLLPLVPRDARDRTTEPAAHAGGHRGLRGLGPARRGGAPGGCCAMGPQLAAVKKLQGVYSAAALFSLMVSLDDRNSLRYVVRVSARVERPASCRRPGAQWPCPGVPEGGRRVRERRGRESRGGEGAHSGSAREEVISNFPGVTAVFSGAAISQPSGRQWGAGGVRGNIFKLMYKAFEV

SEQ ID NO: 782214 - protein, 121 aa, Homo sapiens
LGLPFSLCLCSFPGRGTRSNRGKRPSPTGWAPSICLVPVGKAYPLGQLFSSNSGGSQSRTQPLADAQEAEEKQSLEAPLLVWSLGCKGYLESTGMNALFIHHSPLKHSVIQQTSIEHLLCA

SEQ ID NO: 782215 - protein, 108 aa, Homo sapiens
MLSKIGLKSETCSSPLDTTGLWFLTLRHLPHTGPRDLERSQPCSSCSHSVRSLLPSQPWGAFHASGFWLCRDRGPTSSLLGWGNHPNRSFLPCSVLCDHGPVTPPPWA

SEQ ID NO: 782216 - protein, 107 aa, Homo sapiens
MRMLDSGSYNRLYIPLSRYHSSVTAVSYGILRNLHIVSHSDCTSLHSYQQCRSVPCLPHPHKCLLFVVLCIMAIYVDVEKLEPSYNVGGNAKCYSHFGKQISFSSKM

SEQ ID NO: 782217 - protein, 66 aa, Homo sapiens
RNPSSPGTLSSQVTSTSTIIKHITSYQSHHVVTINTTSIIPITITTTTNIITPINTTITHIRWVRT

SEQ ID NO: 782218 - protein, 43 aa, Homo sapiens
KLDSPATVLHGHRWPALDRMAACSLDPTQLANQPSALGQPGPR

SEQ ID NO: 782219 - protein, 77 aa, Homo sapiens
LRNSGGESNRETPHGGGVRRAEKRGGGVNEWNSSRCVTEYYITPSLHTHGARRSHTRGGQPARTDAAPTQRQEGPGT

SEQ ID NO: 782220 - protein, 103 aa, Homo sapiens
HPCPSWGWHFRVCRIFVWLDRLVPRPLMSHLPFTQHTENKANAVNPIPPPRLLCSSGGTQEEVLKRFHSMTEFHAEQKPRMQVEMWLQKPPSTKNYRKRAVKW

SEQ ID NO: 782221 - protein, 113 aa, Homo sapiens [sequence omitted]

SEQ ID NO: 782222 - protein, 424 aa, Homo sapiens
ASAHSVQGSATAGGARPGRRPWGARPMESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 782223 - protein, 398 aa, Homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 782224 - protein, 392 aa, Homo sapiens
ASAHSVQGSATAGGARPGRRPWGARPMESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYALAGLAAHAQRGAPGLCGMLGPPLPAAVARRGVPGAHLSVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 782225 - protein, 205 aa, Homo sapiens
MHAQGFFFFFLKPLPRELITYLRRLKVVKHDQNMHMWAHVACLHFPKLVLRGSGDVPQTCWDSYGSLARFRNISSHYASQQQYQCWVASWRLRCFSSYCEASFSARVADLTEELLGAWTTSYSPESYSFMADQGPLYSRRLDDDPFGGNTMVTRAGYAAGQSFLGYVAMLGVAYEAPSLAPGSWRYWAHLCCAHVLAHAQCSAHP

SEQ ID NO: 782226 - protein, 68 aa, Homo sapiens
NRVQNHGERKEQVCLSLPEQLGGGSRGWAWWLGSMSCPGIQDPSSLVLHSATVSPLSALSEMASYHRV

SEQ ID NO: 782227 - protein, 67 aa, Homo sapiens
DSISIPHDIESFDAESHAGIFYNRSDMLSTCCKVRHFTTFLIEKTPGAVGQARPRHRGMDPSNSAGL

SEQ ID NO: 782228 - protein, 35 aa, Homo sapiens
MSVLIIMAFLKSNFSQMSSLLQTRITPFYFETLFV

SEQ ID NO: 782229 - protein, 109 aa, Homo sapiens
THIVAAYQERNGGSQVEPIQPLLRTFKVSGGNRDKQNWNPCDENVKTRECSTMGANVLPRICLFRPDLQTRDHPHPSSIPWSSRLVMVKCHHYPTTGLVGFSFKKYKPN

SEQ ID NO: 782230 - protein, 46 aa, Homo sapiens
MICQSKIKVALPKKGGMHAEPAESIAVHYILYRVATKCFELRQTEV

SEQ ID NO: 782231 - protein, 104 aa, Homo sapiens
NRTAVLFCWFSELGRNAHLCCAISSTVLFTPLSAEWLPHAKQCLISVKKDPSSHPHLIIRGTQAQPTSPAPSTARCISLNGCTSIILFADKPKLLWIMTPDPGS

SEQ ID NO: 782232 - protein, 69 aa, Homo sapiens
MGRNAHLCCAISSTVLFTPLSAEWLPHAKQCLISVKKDPSSHPHLIIRGTQAQPTSPAPSTARCISLNG

SEQ ID NO: 782233 - protein, 104 aa, Homo sapiens; identical to SEQ ID NO: 782231

SEQ ID NO: 782234 - protein, 41 aa, Homo sapiens
MPCQYLLFSQNLDLSHFSLDQELVYPVPVLRAFRQPFWLRR

SEQ ID NO: 782235 - protein, 126 aa, Homo sapiens
VQPSPASYPLHHFDYSSSVIILASEFTGIDCSIVSVSAPFWGGYCFVSNNFIGLSECGSALGKVEIFTLYWVLGCLIIIQSSSFNEYGLLTLILIFPKLVILSCQDCCLSATSCLSHGASCAFYIV

SEQ ID NO: 782236 - protein, 111 aa, Homo sapiens
SRVWGSLQLSPLSIWEPLICVLRTMKGFPCPPPVPPTVGSCGPFEYQRSPWPGSCRLQQPGPIHTRLVGAPRALSKPCAPHLDGTDGPLSWVGNDLHVLTLSSSTKPLPCV

SEQ ID NO: 782237 - protein, 74 aa, Homo sapiens
FSGIVSGCVDGQVRRWMDGRMSEWNCQWMCGWTGEKMDGWRNEWMEFSGIFGGCVDGQVRRWMDGRMSRWHSQE

SEQ ID NO: 782238 - protein, 105 aa, Homo sapiens
MPDRDFYVSPRNRVQQRPRGISDVPKATWLSGSAGTPQPILWHFQFSTPCASASISPFNASGRQVSQRGSVTSLMPCGFIIQQPGISSSAEPPRVPTSPLHVARG

SEQ ID NO: 782239 - protein, 68 aa, Homo sapiens
MLAIWAPIVVKAPPGGCPFGCFETIFIDTSVFLMRSLRCGGRVAGRASGEGSLPPPLPLLAFVSSSAD

SEQ ID NO: 782240 - protein, 339 aa, Homo sapiens
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 782241 - protein, 339 aa, Homo sapiens; identical to SEQ ID NO: 782240

SEQ ID NO: 782242 - protein, 339 aa, Homo sapiens; identical to SEQ ID NO: 782240

SEQ ID NO: 782243 - protein, 109 aa, Homo sapiens
QRQTMTLGTWHHHCVLWQQLQFIPFFKYCLLRKSFTCWKKNVRLQGLHRLQKFLENHLLLAVPHFGAGLLHISRLLQELHSVSWLPQELDRCYELLDLQTALAEEKHKA

SEQ ID NO: 782244 - protein, 104 aa, Homo sapiens
LLKLGSVRTLGTLTGQPEQGRGGQCGAVQGGGCPGWKLREFRSGLAGLKRGPLRDFAVSASASRSLTEGGLLPGRIGEDLVIHNQVTAPTGRQFQGHVGSPVLV

SEQ ID NO: 782245 - protein, 153 aa, Homo sapiens
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQ

SEQ ID NO: 782246 - protein, 120 aa, Homo sapiens
WLLTRHPCFLCSFHLLNAFSLNLWSERILPASSKVSEVKAKERNTHTHRPFHIQPWSDQPSRQRFPLLSKNILLHREPRGPLNSHKRQSLQTPLVLIPILPLTLAHSLLLLRASRILIYK

SEQ ID NO: 782247 - protein, 153 aa, Homo sapiens
KPCIILEPSLSHTSRVQFISKHGRNLTPPHHKPLLPPFLPGSLQQPPDRLRCLALHPSLHSRHHSQGFCTASSAQGPPLASSFAQDKYPAPGSHQQGPLPSLPSPPTPLAHSTCSTWSPFTVLSRAGSPRQASAPASPFRFLNQMSRPQWGLA

SEQ ID NO: 782248 - protein, 105 aa, Homo sapiens
SHLSLLCIIKGYRAGCCHKYSAVHWLQCQRLVLMPQLQWALPPGRTALCHSGVQAPSRLLLCHPSVAVLASPDQVTCLQVKHTWNLRTSGTLTFRSHLGGGILES

SEQ ID NO: 782249 - protein, 80 aa, Homo sapiens
VDIGHIHLFQNRHIVGGKHSQQCKRMEITTNKPDPGHEIVLSLVYEHQKEGLVQQQPEPTDSMGQIKIQNSAKMLKREET

SEQ ID NO: 782250 - protein, 78 aa, Homo sapiens
YHRARHPPTEISHGDFFAVRVSEEAPHQPLCDFRPTRAAQESFLPPATLVTPLNLEGTFTDKEGGDLFSITCGTGMLL

SEQ ID NO: 782251 - protein, 94 aa, Homo sapiens
GLSFRRPNVITLLEKGKAPWMVEPVRRRRAPDSGSKCETKKLPPNQCNKSGQSICQKLVSAQQKAPTRKSGCNKNSVLVKPKKGHSGKKPLKCN

SEQ ID NO: 782252 - protein, 85 aa, Homo sapiens
TIGIDISCPDSQGLGAADSFQHVFSTSSLDSAVAAAMDKTVKKAARGWRYLSLMLDLAEGRTALTRSVVRSPAPQPSLLDPASTV

SEQ ID NO: 782253 - protein, 45 aa, Homo sapiens
MTCRNHALGHKTSSEQIQNADIQRLFSSNPPQEPNFLMKFCGIDK

SEQ ID NO: 782254 - protein, 85 aa, Homo sapiens
RLQREVAQRTSEGAMHEKLIHELEEERHLRLQSEKRLQEVTLESERNRIQMRSLQQQFSRMEETVTKSIAAVKDLQQQKNSTANC

SEQ ID NO: 782255 - protein, 275 aa, Homo sapiens
MPSQITHILCLNCPPSGIGLALCKRLLAEDDELHLCLACRNMSKAEAVCAALLASHPTAEVTIVQVDVSNLQSVFRASKELKQRMIKKWLYVICVEDHVSEIDCIYLNAGIMPNPQLNIKALFFGLFSRKVIHMFSTAEGLLTQGDKITADGLQEVSRPMSLAINPDSGNWSLSSVTVTSISVIWTHLAVAGIYFSLEDSSKERHEPKSPNMPMDLAGAVTTEINQEELNHKGEYSTDVHCNWKGTNIVPITGNDTRMRTICTNRSDPSCHNTSY

SEQ ID NO: 782256 - protein, 107 aa, Homo sapiens
VNSGCYSLNKTYKMDKASQCSRQLHPRYRQGCARPAWRGRLGEQDPSVAPGAALPGPEQDLGENAVFLPLFPRNASIQTILRLSRSPPRPAPLPRDSHLKTQKTLSP

SEQ ID NO: 782257 - protein, 55 aa, Homo sapiens
MQEEEVAAAEEEEVVVEEGEEEEEKEAKEKEAKEKEKEEEGDEMMNKDLRRRRCE

SEQ ID NO: 782258 - protein, 33 aa, Homo sapiens
MKTKEKETREEDQKTRTKRKVMISISHIFSNRL

SEQ ID NO: 782259 - protein, 105 aa, Homo sapiens [sequence omitted]

SEQ ID NO: 782260 - protein, 107 aa, Homo sapiens
HRQPKETDTQAYTLTHTHSFACSHQTRDKLTSPTDLDTPPHQTHTHRYLHTHHGQRQTHTCLGTHTQTQTHTHSPPDLRAHSKPLCAHTVQTHRHTRDSSPGTDTHM

SEQ ID NO: 782261 - protein, 799 aa, Homo sapiens
SQRPLPRPPRLCQRRLRGGGRMKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 782262 - protein, 799 aa, Homo sapiens; identical to SEQ ID NO: 782261

SEQ ID NO: 782263 - protein, 734 aa, Homo sapiens
MIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 782264 - protein, 765 aa, Homo sapiens
MIDTGKAFCVANKQFMNGIRDLAQYSSNDAVVETSLTKFSDSLQEMINFHTITQSQAVLYSSVRMDYTVVLDNIWKNSLDYQILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 782265 - protein, 799 aa, Homo sapiens; identical to SEQ ID NO: 782261

SEQ ID NO: 782266 - protein, 439 aa, Homo sapiens [sequence omitted]

SEQ ID NO: 782267 - protein, 405 aa, Homo sapiens
SQRPLPRPPRLCQRRLRGGGRMKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSPRI

SEQ ID NO: 782268 - protein, 407 aa, Homo sapiens
SQRPLPRPPRLCQRRLRGGGRMKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKHGKKSACKSTRPR

SEQ ID NO: 782269 - protein, 129 aa, Homo sapiens
VPAAAPAAPSALPAPPARRRQDEDDCGFRGVSEGLAPLQVTGTAARRHRGAPSRRWGRESRARAPGGGPASAPSDGASGCCRRFPPCEGTAVPTEPSRGATKWRGRGRRLSFLSLPSAGAERPEGRRTL

SEQ ID NO: 782270 - protein, 833 aa, Homo sapiens
DADFCFAVPPARATLRRAPAVDACGNRGGKRCDQPHSVDPSWAALEEVEGDVAELELKLDKLVKLCIAMIDTGKAFCVANKQFMNGIRDLAQYSSNDAVVETSLTKFSDSLQEMINFHTITQSQAVLYSSVRMDYTVVLDNIWKNSLDYQILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 782271 - protein, 447 aa, Homo sapiens
MLFPFRSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 782272 - protein, 600 aa, Homo sapiens
SQRPLPRPPRLCQRRLRGGGRMKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVIAVNSDEARRESLFCPDELDS

SEQ ID NO: 782273 - protein, 174 aa, Homo sapiens
MNEGTVGGKPRENFGYSEEGSGECGERQVRARCSHLFPVPASRLAHASLPPEILQRRRDPGGALRMPFRKLLLPRAWGLWCSGMGCDAGLQQGLRPLHACHKRFLVLRSRPGCSLPRAVLSQHPQEGRPQAEKPAGAYCPEWASNQPLLGFWGQGPVHKPLQVPPSGLPSPQGW

SEQ ID NO: 782274 - protein, 131 aa, Homo sapiens
GVVSQCGGAALGVLPLAGLMFLSRAVSSLSLSFPSCQIKGTRLRARQGLFPVPSSSWVESPPFCCNAWLPQSPCGLGTDRETEAQGSPPAPASLLEALGSVTTATLHLCVCVWLAGSLSSPTIPKFPGLAV

SEQ ID NO: 782275 - protein, 102 aa, Homo sapiens
MAPGVESDSNLSLPFVSTFPALAFSAAIHLPHPLQLSLSLRFPIPTLQQRYSIASSHSTRTPSYKHGHYPGLHLLNSGYSFHNVSILSLPNSFGKPFSIPSQ

SEQ ID NO: 782276 - protein, 68 aa, Homo sapiens
NHGPFLVLSLLNRTCHAMPLASTFQESHCHLFPLSLPLPSLQLSISRTPCNFLSLSVSLYPLSNKDTP

SEQ ID NO: 782277 - protein, 68 aa, Homo sapiens
LLDLSLFPCKANISTPLQDDLLLHAHSSHWLIAAREPPNPSENCCETEVCLSFLRTRMSQKPSTHGNS

SEQ ID NO: 782278 - protein, 103 aa, Homo sapiens
TVIAPPLRAHLCLYALRFFFNSMYYNPVFLFCYSDGRSLGHGKLRQLGSYVLSSCFPNFLFSATTGHSGCIWNFLGSSSGVRHLRERWSHRSCCKGVSALSLT

SEQ ID NO: 782279 - protein, 117 aa, Homo sapiens
SVFLLCPHMVKSKERVEASCLGSLVVKALIPCRASPLLFNHPPKAPPTNIMSLEIKASIYEFWCGGRGDHKHAVYKMLFNFLRQDLALLPRLQCSGMILVYCNIYLLDPSDPPTSVS

SEQ ID NO: 782280 - protein, 139 aa, Homo sapiens
VPSLLGCPDGPEQGRPWSSPYTPRPAVQHRSQPGPAPVCDLPRTSAFRVSCWLRCYHRLFLDYFRGWLGFPFPFLRCSVMRSFNFCLNFVCLSFSPLACSLSVHAVADSVFAAHSLLPLVFIRCKLRTCGECLLPPAPS

SEQ ID NO: 782281 - protein, 103 aa, Homo sapiens
KERKKERKKERKGREGGKEGRKEEGRKEGRKEGRKEGRKERKEGRKEGRKEMLVPNWYHPQRASHTFSHAFCLDRRSNSLSLWYLGLLEPVLLEINYTSLFAI

SEQ ID NO: 782282 - protein, 51 aa, Homo sapiens
RCLLFSRKLTVASPDPHSHLSDPNPQDNAQSGSTTGCWLQGVDCSSASTGK

SEQ ID NO: 782283 - protein, 161 aa, Homo sapiens
VAGAGDCLRRLFGSYRKQWLEMTLLRRWFGSYRKQWDKGGGDLHPEHACQTHSCPLHTLRCAPSSLLQRGPHGTHVNGTKLLDVWSSVPKASGVPRETRWLPYEHVKEAQVPDLSTEQFLALMLLMGIVYREQTGLEDQQVHTEATSKGHGSSTVGPLLSL

SEQ ID NO: 782284 - protein, 98 aa, Homo sapiens
PRDFPRTPRGETRKPLLQPLLPSPAVPRRPVIALKGFSTRAHLPSDNLIPPASSVPWHPFCNGLLDSYYCLLFAAYGMINSWQGCTEVAGKEKLGCAE

SEQ ID NO: 782285 - protein, 59 aa, Homo sapiens
MITYHHAPEVGSFKPPAAAGSIQPRKTPTSFPLSATLSCLLFQISSPSYPLLIFQVSDT

SEQ ID NO: 782286 - protein, 119 aa, Homo sapiens
ACLTGELTQGVHAQEGVWVLCSTAGLELRSRPKVSLSTTISTQTNNEKGKQKDMPYQFLMYLLNTPVQFAEFVMSSLREKKRHYKLNGNVQQVCHELICWFQQIFPSKGQGLMDQLHAQ

SEQ ID NO: 782287 - protein, 94 aa, Homo sapiens
LRHQLEQAVPSAPRENEAGAVCLTGQGLHGAQGSAWQSHWGAHGGFPAFSGRDPGPSRRTPVPHEVFPDPTADRQHSLQEWGSGTRKGPAWVTE

SEQ ID NO: 782288 - protein, 185 aa, Homo sapiens
QIATETDVPEVEASEVGQSPITPTLVPPVHPSPPSSRSPQPGQDKESGEAQVTPTGPPLSEPLQGPGPTPLSPQRIQDEEIESDKLPPSSSHHDPPKDSSHTDLVQKLAGDSQQALKEETSKPEAIRVSIPHPELPHPQDLATDTKQPQARGAPGTLLPRSRLAPTRLPQPQVLAPLQSRRPTPK

SEQ ID NO: 782289 - protein, 35 aa, Homo sapiens
LKRELGQASPVTGWAHVKEPQQLMGWTFKELLRTF

SEQ ID NO: 782290 - protein, 66 aa, Homo sapiens
VLVDCCWGDGFEATSAASSNVSSRRTLVAAVLGSAIVLRWCDPVAPAARGPFFLSHVFFKLNIERF

SEQ ID NO: 782291 - protein, 71 aa, Homo sapiens
MGAPGEVDTLQGGGCVPRFQDTIWPHPGPGAAGAGPVLSLLSDTAPLSPPKAPTLVGSAPTDLMKLTGVKH

SEQ ID NO: 782292 - protein, 107 aa, Homo sapiens [sequence omitted]

SEQ ID NO: 782293 - protein, 133 aa, Homo sapiens
PSIYPFIHLSIRLSICPSIRPSLHLSLSISPSTSLAISSLSIHPLLHSPTPPSSFSLSGFPAPSHLWSCPWSGQAISSLQSLDRPQPQLFSAAQLGRLGRYLLRGEAYGPEKAWACLSPSFCSRDEAHWALVS

SEQ ID NO: 782294 - protein, 124 aa, Homo sapiens
SFSHSQLTAFQPVPYVKRPRGFCFRHFPDWPTCDPRGDPILISRAWGPSAGNSSLVVFTPRGTSVPIHWTGCADCPQVGTAGPGSSTALPSGQPRTRHLASIRRMYSINHRRIFQSLLRDGDLT

SEQ ID NO: 782295 - protein, 40 aa, Homo sapiens
MDAGPVLVHCSAGIGRTGTFIVIDILIDIIREKVLTATLM

SEQ ID NO: 782296 - protein, 141 aa, Homo sapiens
RQGPPTPAWAIPAQPSRGPGYSPCARVAEFEKRDRVSLCHPGWSVVRQSQLIAPPPLGPSYPPTSASQVAGITGAHHQPRHSLITLSPRLECSSAISGSLEPSTPGFQVILLASGLPGDRLGITGGQGIFLAGHIQHSKGM

SEQ ID NO: 782297 - protein, 68 aa, Homo sapiens
RPISAKGVTVKKLPLLPLQLACAYGAKAQAVGGKGKPRAQPATSDTSRRITDWLCSPAFEVPSFYQNV

SEQ ID NO: 782298 - protein, 116 aa, Homo sapiens
FLFLARNCMRLQVLELDHVSEITQEVAAEVCREGLKGLEMLVLTATPVTPKALLHFNSICRNLKSIVVQIGIADYFKEPSSPEAQKLFEDMVTKLQALRRRPGFSKILHIKVEGGC

SEQ ID NO: 782299 - protein, 52 aa, Homo sapiens
MKTSKSAEKKLWIHRSGGAQEGAYRLPSALVQGRIVRATSNTCKVFGPYPRQ

SEQ ID NO: 782300 - protein, 239 aa, Homo sapiens
MSNNNSQQPQLNRQTIHPRIHSKAHPTDSWTWSTTRVTSGTTTTRGSNTPCNPNRNTQQPTTEHNTTNQKHDKNSNQQQNDNKRTMTHRTIQYSTNEKKNHQHTTDRKKLTTTRDNRQQHTMKANHPTPDTAPTNHTPPTQDTATDQTERAHSTDQAPRNGRHARHKKKTKQDYAPPRHTTPQRHKLKGRRRPPHRHNDKAKTTPQHTQHANRTHTTKRHVRRIRHTNAPTSTKKTRRA

SEQ ID NO: 782301 - protein, 58 aa, Homo sapiens
VACGNNPVYDNASIAEQITNGILLEILDYKLPSCFKEHLIPHSYYPLKPEIILQKLQS

SEQ ID NO: 782302 - protein, 64 aa, Homo sapiens
MKQKWLRPYPPPLCRLSHRTNPTPAYVKLHAGAPEQRDRSLIPFYEACVPPCIHSGSSEKHYLA

SEQ ID NO: 782303 - protein, 154 aa, Homo sapiens
SILPLFGLGRQKTLSQWPLNLPNPSKVAGFMKTLNSYEIKATSLEWHARLSTVWVNSHLLLPSLSALSNTFHGFQLQCLCSHHFLCLKYLFFPFSPKASPSSSSSCSNASSSKMLPRILWETHLPLLELPQRHKASHGICLSVIWCFVKNYPFC

SEQ ID NO: 782304 - protein, 88 aa, Homo sapiens
GRSRPHLSGLWRFQPQTVCLRRISGHPRTNFRISKFPSLGIVKPTQVESTMTHSTYQKYFPQLQDLAFKTGRFLPHVLLGFADLIVSI

SEQ ID NO: 782305 - protein, 31 aa, Homo sapiens
KFPPVPRPQWSLAGGLLEPAAYLSCIGMKPG

SEQ ID NO: 782306 - protein, 74 aa, Homo sapiens
MIPTTTITLIAPLPSYLPSETTAITVTMTNTILPPLPLICLIAMPIITNSITTTLQLTNAAAIITAMICTTTTA

SEQ ID NO: 782307 - protein, 41 aa, Homo sapiens
VEPFASLTELGQQPWGWGLPLSPPAQQRGEEGTAETQLQYV

SEQ ID NO: 782308 - protein, 104 aa, Homo sapiens
MLHVFKHVFLTLAPLKTRFCINRRSCHRPFRSAQHEEENQPVPPLATPKTRQVTQWKEPDRVTGATPSLPSLPGRLQGQVTSRLSLLPLLLRGSHAPSPLVVGK

SEQ ID NO: 782309 - protein, 38 aa, Homo sapiens
MNSSDALQNLHFIDSFLSVQVRNLLPYNGSLCPPAVDG

SEQ ID NO: 782310 - protein, 104 aa, Homo sapiens
MPPLASTPDPWPVVRGANNMTCFHLDLPSPPREKGILAKKRLEEGRTLALRVGLGGAQATLLVRISWLFKVNMMMISLGFLSILRSRPELESTCILGEARGGKG

SEQ ID NO: 782311 - protein, 102 aa, Homo sapiens
MSSLKNISFSFFKKMIWGTGAKQKQFIPPYPGMKSNHASCLLLMVSLSFTCLSLQDQDSIPVPTPPPSNVIPPKACSSAHWVKGILSTQAFHYCLDFFSADH

SEQ ID NO: 782312 - protein, 77 aa, Homo sapiens
PPHVSRDQATSPQPGSPVPVGITDHTQFWNPVFALLDVGSCPLWLCHFSPCCPCGHNQGLAMTCSSLGSLLSCQRLF

SEQ ID NO: 782313 - protein, 60 aa, Homo sapiens
LGRTVIKVRDWALSDEPWAFHSSSQKCCLCSMMCQALPKALEIQQGMNGQKFHFHGAHHV

SEQ ID NO: 782314 - protein, 77 aa, Homo sapiens
MGSGHTTPKYTLATECLQLEKPEKEHVQEGLFDRPLKQVGSPWCEKRPAGTWRKGASYRETMERGWNDMPGSGPRSL

SEQ ID NO: 782315 - protein, 80 aa, Homo sapiens
CTPGQPGSVNHAFPCFAIANQISGSATESSYSNSRPQPPTSRQPPVSLATDLLLRGKATGRLSVPLRNVKRASSPQPGKK

SEQ ID NO: 782316 - protein, 718 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRLVNQRLLEVQSQVEELQKSLQDQGSKAEDSVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAEDRLASTGSGQSFLARQRQATSSRRSYPGHVQPATAR

SEQ ID NO: 782317 - protein, 68 aa, Homo sapiens
MFSVESLERAELCESLLTWIQTFNVDAPCQTVEDLTNGVVMAQVLQKIDPAPSQFTCHFNDNSCSFWG

SEQ ID NO: 782318 - protein, 594 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRLVNQRLLEVQSQVEELQKSLQDQGSKAEDSVLLKKKLEEHLEKLHEANNELQKKRAIIEDLEPRFNNSSLKIEELQEALRKKE

SEQ ID NO: 782319 - protein, 738 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRYLCPSNFPLTTAFAVSHRFRLVNQRLLEVQSQVEELQKSLQDQGSKAEDSVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAEDRLASTGSGQSFLARQRQATSSRRSYPGHVQPATAR

SEQ ID NO: 782320 - protein, 415 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDREAA

SEQ ID NO: 782321 - protein, 547 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRLVNQRLLEVQSQVEELQKSLQDQLKMLYNSVILFFV

SEQ ID NO: 782322 - protein, 655 aa, Homo sapiens [sequence omitted]

SEQ ID NO: 782323 - protein, 205 aa, Homo sapiens
RSEDPYARSQVEELQKSLQDQGSKAEDSVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAEDRLASTGSGQSFLARQRQATSSRRSYPGHVQPATAR

SEQ ID NO: 782324 - protein, 68 aa, Homo sapiens
MAISSVAEFRRTDSQLQGQVLFRHLAGLAELLPESRRQEYMQNCEQLLLGSSQAFQHVGQTLGDMAGQ

SEQ ID NO: 782325 - protein, 140 aa, Homo sapiens
FFQKAALKIGLHEFTNNLSWISLFHCFPLAISSSSFTSCKSKVPAQHRASDSASMPAFHRHPEPQHPVHSSWTPLLPSALKKVLTSFWDPTEDPGILHPGHTWNFLGELCKKCSCPGLTVELGANHESRVQAGGSREPPL

SEQ ID NO: 782326 - protein, 32 aa, Homo sapiens
MSTFFAFKLLPESSSWSLILFPPAAARTTNIG

SEQ ID NO: 782327 - protein, 108 aa, Homo sapiens
LGFGCREEARVEAGALLRARRIFTFPLISLTEAGCRAFASSDWWNCLHPGPGLPGGGGGGGGAGTRDGDLASSLLSRPQYPSCLLPGDPLGALPLRAREKGASGTERP

SEQ ID NO: 782328 - protein, 92 aa, Homo sapiens
KNCSECHSVKPKPHIREPLASSRTRTDILGEQGQLPPCCDLLGELPVIGWQPSHRSLAKNGTTVDRIREKHSGQHQERFRSRARHRAPHAGC

SEQ ID NO: 782329 - protein, 91 aa, Homo sapiens
EYVGELISDAEADVREDDSYLFDLDTKDGEAYCIDARYYGNISRFINHLCDRNIIPLSQSTDPFSVRHPRPTPASWPAHATTPTLAPLLGI

SEQ ID NO: 782330 - protein, 763 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 782331 - protein, 763 aa, Homo sapiens; identical to SEQ ID NO: 782330

SEQ ID NO: 782332 - protein, 221 aa, Homo sapiens [sequence omitted]

SEQ ID NO: 782333 - protein, 763 aa, Homo sapiens; identical to SEQ ID NO: 782330

SEQ ID NO: 782334 - protein, 242 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQHPGISNMLDNLFINGKINFKKKLPRAPEA

SEQ ID NO: 782335 - protein, 110 aa, Homo sapiens
AWGDEEAGGRQERTLPLLRSEQSQGSPWGPGPRFPADPCRSWEGRASASTMLGEGLPGPRHLDTHLSRAYRDPASPHSSSSHQSSGAQHSSAAVRPQAGHRPLSLRQVLP

SEQ ID NO: 782336 - protein, 1383 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 782337 - protein, 243 aa, Homo sapiens
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLQNMLPQSATDKPF

SEQ ID NO: 782338 - protein, 117 aa, Homo sapiens
GTMGGSARPLLLESELPSREATSLLSSSMRQWTRELTRQTHLCTLPHWNQSFCPGKPLSHWSLSPRSNPDHQHRTPDQGTRQAPQVEQCALSRWNRSLHLGKLPASCPPAPDSGPAN

SEQ ID NO: 782339 - protein, 151 aa, Homo sapiens
CPLHRSRRAWPEGQGASAGFLHCRTPCPVPPAPRVLGPHRPNMPRTLATAGAGPPSWRAYPLGHLMNVSPCSRSFPNLSPECLSSPWLLLHNLHPSVPTPGAGLFSGSGRLASVNAGLSQLLTQEGPRAATFSPCSRFEKVFPWEACVKCV

SEQ ID NO: 782340 - protein, 111 aa, Homo sapiens
LSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQP

SEQ ID NO: 782341 - protein, 77 aa, Homo sapiens
EIRKASVGTAVAAWCLRGALGSCLASDPLSLLRPGPRPQGYGHSEPSSQVWPVLSQDNFAQLGTLGSVTTTLTLCTL

SEQ ID NO: 782342 - protein, 32 aa, Homo sapiens
MVVQVCESVCDIYFHSGYEDERGEYVDGLRPG

SEQ ID NO: 782343 - protein, 118 aa, Homo sapiens
REDDSSQEEETTEHLQWGGAKDENLEEEDEKKQDDLQLLFCLYLLAWLAGTRIFSVTYMMNLGVTLDSFICLSRVIQLVSWHYLSCPYSFLNTSLPCLIACLTPVPIIFLINHRATDS

SEQ ID NO: 782344 - protein, 38 aa, Homo sapiens
MGLLFKLVLDIGVSFRGIAPKPITDALTCSPIFWEFLV

SEQ ID NO: 782345 - protein, 105 aa, Homo sapiens
MCPVSPDTPPECFALGCRSLWPHSLRLISGEDCGVAMLCVHDLRIIVTLRPGFRGGRRVVGVLLAPNYHHYRRVSRTCVLVGEEFSWVSELCAALCHSLRLMGTE

SEQ ID NO: 782346 - protein, 77 aa, Homo sapiens
MKDHDLGLFRDRLGHLVMCHLQQLCLHTSSLRLLHVVHKTALVHHDHDLHMRPVSPPLTWAIEKGKSLRSSSWPLLP

SEQ ID NO: 782347 - protein, 74 aa, Homo sapiens
MIKHSWIHLYVMASAMSSSPIFFFFQRWSLTLSLRLECSSAIIKPTAASNSCVQVNLPPSMCDYRHEPLCLAFL

SEQ ID NO: 782348 - protein, 65 aa, Homo sapiens
REDTAHGTQRMEGAAEGWTRGHGTLDAARGGGSRGLDKRTQHRGRSAWRGQQRAGRGDVACRTQH

SEQ ID NO: 782349 - protein, 110 aa, Homo sapiens
MGTHQRFILKCKFQPLSIFKGGCSAEETSAFSAREFPSYLNWGATQPSATRGSGRLRPVKNWRFFPPLSVERLSTPSVTKIKAKSPLQKQREPGLRRAQRRAVCLSLEAK

SEQ ID NO: 782350 - protein, 80 aa, Homo sapiens
AVDLEFPTTGLQWALSCQMDNGGRDGAKELGGNGGYSLRNMTPDPGKGRESCLLKPTALSLPGSQPLHLAETTQRFTSPR

SEQ ID NO: 782351 - protein, 228 aa, Homo sapiens
MVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDVIKSRMQMDGLRRRVYQGMLDCMVSSIRQEGLGVFFRGVTINSARAF

SEQ ID NO: 782352 - protein, 224 aa, Homo sapiens
MPVEEFVAGWISGALGLVLGHPFDTVKLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPNPTHTHALIIALACASSESLICFSASPLDCELPEVRDCALDGFQPEPGA

SEQ ID NO: 782353 - protein, 270 aa, Homo sapiens
MPVEEFVAGWISGALGLVLGHPFDTVKVRLQTQTTYRGIVDCMVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDVIKSRMQMDGLRRRVYQGMLDCMVSSIRQEGLGVFFRGVTINSARAF

SEQ ID NO: 782354 - protein, 84 aa, Homo sapiens
QVLIDNNGTLGYRQQTHTHNHSQTSMPFSNNLQGLRLTDNNHTFGCIPHGQHSQMHTILHHSQTCVLPDSLQKHTHRHYLPAQI

SEQ ID NO: 782355 - protein, 105 aa, Homo sapiens
LLPVMNLPSLFHKPPCQVKRLLLGEAPQDLSHSRGTLYLPCQMPPLPHGVPRCIGTSLRARMCLILLLSLQAWSRGRARIYRTRLGAVAHACNPSTVGGPDGWIT

SEQ ID NO: 782356 - protein, 40 aa, Homo sapiens
MLKSCLCAQPSCYPVTDPPFAPPWVSTGSVGPRWSMAMGT

SEQ ID NO: 782357 - protein, 130 aa, Homo sapiens
SQVVPPLAMDPLAPMANPSLLKIQKLARCCGVCLWSHAAREAEAGELLEPGRWRLQGAKTVPLHSSLDNGLRLHLKKKQKQNVWASGDSRFISPPTAHTLSTEKLQALDTNPAHESSHGGYTLQSHRCTV

SEQ ID NO: 782358 - protein, 69 aa, Homo sapiens
SLSPSSVEPELSNAEPSSGRREESFSVSWRCEVRPRKGQLSVLLAAPALALLSGTTTRNSDRFDAELRK

SEQ ID NO: 782359 - protein, 132 aa, Homo sapiens
VSVVHMLCMCVHACECAWVCVCMSQQLSLGFPVPVSRRRRPLHFLGSCLCSTGHSKGSLGWVSPHSNSTCPGSHHRVMERVLVMRWSVCSATRAVGPGSGHTSLGLSFLTGKMWQQNLICEPPLALNNSGSR

SEQ ID NO: 782360 - protein, 48 aa, Homo sapiens
MRNPVSTKTSQAVAVDFSTTNSAENTMIYIHSKLQVHLFFLQQKTISL

SEQ ID NO: 782361 - protein, 249 aa, Homo sapiens
APAPLWDCQAERKEGSLPHSDDAGDYEQLFSSTQGEISEPSQITSEPEEQSGAVRERGLEVSHRLAPWQASPPHPCRFLLGPPQGGSPRGSHHTSGSSLSTPRSRGGTSQVGSPTLLSPAVPSKQKRDRSILTLSKEPGHQKGKERRSVLECRNKGVLMFPEKSPSIDLTQSNPDHSSSRSQKSSSKLNEEDEVILLLDSDEELELEQTKMKSISSDPLEEKKALEISPRSCELFSIIDVDADQEPSQS

SEQ ID NO: 782362 - protein, 68 aa, Homo sapiens
RPLPRSSGICSRRLRGRAGMKMTVDFEECLKDSPRFRCRESRGLFYRLLFPKSLVQCVTSILELGSPR

SEQ ID NO: 782363 - protein, 236 aa, Homo sapiens
PILDKVGSLVNARLEFSRGLMMLVLEKLATDIPCLLYDDNLFCHLVDEVLLFERELHSVHGYPGTFASCMHILSEETCFQRWLTVERKFALQKMDSMLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQTGCTGGVAENNTLSKLQLGPASLYGELCL

SEQ ID NO: 782364 - protein, 79 aa, Homo sapiens
YDNDNANTFYSLRSIFLNLKSSPSLLPHQPIIYTRTAIVRAENWSSSYYLVTHMLLTMPFRADTDLPLPPPKPACQGGY

SEQ ID NO: 782365 - protein, 88 aa, Homo sapiens
PQVILFEMQKAIVIQSLDDLRSWRVHLGICLSFWKMWNWSFLLEKALSQERATVRELQVRCKDLSKTAGEGRVRAAMGAVVQGLVRGS

SEQ ID NO: 782366 - protein, 33 aa, Homo sapiens
MSSAFMPSPGSSLFLRKQPRVTHFPVDTGYQEK

SEQ ID NO: 782367 - protein, 106 aa, Homo sapiens
PKTASAGGDAHPPICLPMPLLPGLTSASSTGPRPASPMVVASHYLTTTSYFSSPLKLPQNQNYSLTALLLPVPGLLHSLLTPPACRPPFTPSAIGPTAWPLQPPSH

SEQ ID NO: 782368 - protein, 49 aa, Homo sapiens
AKHLLEVKVALTQNHCFKLFLQEEYYLFVKILATIYVSGTETKKTNKHE

SEQ ID NO: 782369 - protein, 171 aa, Homo sapiens
CGSPNPLVWEGREFQAQTRSHCPGVRIPRLELSFPLNCNMILSQVLCFSGPQFLHLRCGRGWRDDLQRALTMDDFAPRRKGGQWFPSLSRGLGQQGDSAYLRSLGSERAGPASYLEARGSHKQVTQAVDHKSPHKKGDETWGEWRREPCPAVEPTKDPRLQEVKPPGLQAG

SEQ ID NO: 782370 - protein, 171 aa, Homo sapiens
SLIFKLDFYYLIEKRKRKTEEKGVDKDFESSSMKISKLEVTEIVKPSPKRKMEPDTEKMDRTPEKDKISLSAPAKKIKLNRETGKKIGSTENISRKSDGERERSPRSEPPIKKANEETPKTDNTKSSSSSQKDEKITEPPEKLILDQQKSTRKQHQSRKEKVKKAFPKMSN

SEQ ID NO: 782371 - protein, 1434 aa, Homo sapiens
HASADAWVRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEESKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782372 - protein, 880 aa, Homo sapiens
FGKVCYVAKVTVTTEQMKRKKCTARKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782373 - protein, 753 aa, Homo sapiens
EIVKPSPKRKMEPDTEKMDRTPEKDKISLSAPAKKIKLNRETEEENWKYRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782374 - protein, 220 aa, Homo sapiens
ARYPVFPFVSSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782375 - protein, 1677 aa, Homo sapiens
QTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782376 - protein, 1218 aa, Homo sapiens
KILAISAQVPTATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEESKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782377 - protein, 1625 aa, Homo sapiens
QTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEESKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 782378 - protein, 1680 aa, Homo sapiens
QTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKKLKKHKKHKKHKKHAGTEVQESS

SEQ ID NO: 782379 - protein, 1615 aa, Homo sapiens
QTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSRRQTVSRRSSEGILRTT

SEQ ID NO: 782380 - protein, 171 aa, Homo sapiens
QTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECKKC

SEQ ID NO: 782381 - protein, 42 aa, Homo sapiens
MASLACAWVWQVAPRFLEKLRNPSTEGPQLTRGASPLPPQCT

SEQ ID NO: 782382 - protein, 67 aa, Homo sapiens
TPSPQSHTLGLCTGSVEPPELQAQGPVPDRHSRNLGGINKVISSQAGMSITRRFDSLCTHQGAQQEL

SEQ ID NO: 782383 - protein, 84 aa, Homo sapiens
LVLLVQGSLRADLSWTPSPVSTGPLMLSLKNLLWSSESWDMVYVGVLQRDRINVLYRYRRGDLLREWAYAIVEAAKSGDRLSAS

SEQ ID NO: 782384 - protein, 49 aa, Homo sapiens
NRLSCVHVGSAGKDAAGRCSRDVFGFHHGGAGAWITHMDTTQPINLPLR

SEQ ID NO: 782385 - protein, 395 aa, Homo sapiens
FCGEPPAIKDAVITGNNFTFRNTVTYTCKEGYTLAGLDTIECLADGKWSRSDQQCLAVSCDEPPIVDHASPETAHRLFGDIAFYYCSDGYSLADNSQLLCNAQGKWVPPEGQDMPRCIAHFCEKPPSVSYSILESVSKAKFAAGSVVSFKCMEGFVLNTSAKIECMRGGQWNPSPMSIQCIPVRCGEPPSIMNGYASGSNYSFGAMVAYSCNKGFYIKGEKKSTCEATGQWSSPIPTCHPVSCGEPPKVENGFLEHTTGRIFESEVRYQCNPGYKSVGSPVFVCQANRHWHSESPLMCVPLDCGKPPPIQNGFMKGENFEVGSKVQFFCNEGYELVGDSSWTCQKSGKWNKKSNPKCMPAKCPEPSLGHWTRTNRLKAWGSTVLFAELTAANSSQ

SEQ ID NO: 782386 - protein, 76 aa, Homo sapiens
STTARPHTCPPIDTVLSDANTLWHMLCLCQKCQPRAFVARLQCLLFQEVSHTFLGYSSSVPLLLYNQDTGVKPQRD

SEQ ID NO: 782387 - protein, 84 aa, Homo sapiens
RTQRTEVLPLIERKTRQKQKQRGVGSEQDLLPRAERPAPERGSRLVQQRCRSQKERPGKEWAGLLFARSELVQWKGSGAATHRM

SEQ ID NO: 782388 - protein, 98 aa, Homo sapiens
TSLQRQAGSPTWSAERKPLRVCCTAPWGPWLPSPAKAKTPASEEAQRKKNKRAREGSPRRAAEWLAGGSRPSRVASPAADGPEDARSEKLDSGRRRAT

SEQ ID NO: 782389 - protein, 70 aa, Homo sapiens
PQRQSLLSSNLLHPQMANSLSPPLPKLMAHSEHGPCVHSSIPCVLARNAGSWASPDLPKWRLWGQGPGKH

SEQ ID NO: 782390 - protein, 159 aa, Homo sapiens
PVIQLSSTSGISYAESQTVIPVKKGQIYTVSGLLKTDIDSLGTSGGAWIHVYYYGNSGSVNDFATKLVTTDTDWTKYVKTLRPQEDGYYKIRLEMKNASGKAFFDNLRFSYANQVTEYLYDAKQNYVTQIKNQQDQAATYDLDGYGQVKKVITPENQLL

SEQ ID NO: 782391 - protein, 59 aa, Homo sapiens
RPPDGLHLTLVPDPLDSPSSVPQNEQQPHPMCPQDEEGPRQPPGSTRGQVPSPSHRPTG

SEQ ID NO: 782392 - protein, 105 aa, Homo sapiens
RFPELMLMLTKGCGGFGEPMPLMITQETCLAHQIRPHSTHRTVSWLQLVRPVLRRSLTRQAKRSMGMTACTSVSRGLSGWRGRCVSLPNKECVTEQSGHCPASPE

SEQ ID NO: 782393 - protein, 107 aa, Homo sapiens
APPHPRNLSPQYWVSAFPSTSLRILRNAYQVRGPGLSPAITSGWAVLGLGLVFLSHSPVSQGSFYTGSADCLTKWPCRLFSLVSGFMCPCHYTPVAGSTPREGVGGP

SEQ ID NO: 782394 - protein, 85 aa, Homo sapiens
ELNFQDLKNQLNHMSVSSIKQAVDFLSNEGQEKGGVLVAPPVRSVSELRAEQLLAGLVGPAAEGVAETPLTEGIGARDGSLSCSQ

SEQ ID NO: 782395 - protein, 77 aa, Homo sapiens
GHVAGQEGGFERKFPESSEVRDGSHCTLQNIDRAQEAEMNGWACGKVKGPEGHRAVDASNGFGDSRSWLGTRLAQPS

SEQ ID NO: 782396 - protein, 45 aa, Homo sapiens
MPVAWPSPRTSPPPSPLWPLQMNAAAAFSERFSALDLHASLPRHI

SEQ ID NO: 782397 - protein, 99 aa, Homo sapiens
MGTLAVAVKLYILHKYPTVDVLRFRYLLKQALATGMCRSLLARPLNSEARGATGSFKLDPKQQEENPAQGDGPLMVPRRAEKAKGKDAKKPSEAKEDPP

SEQ ID NO: 782398 - protein, 67 aa, Homo sapiens
PGNGAQLRTSVEVSVGGIRGKRHERGMKSEVGRGRLHEAHGPQEGFTMKAMEIGGCRGLLGESIRNF

SEQ ID NO: 782399 - protein, 81 aa, Homo sapiens
FQNGPLFRKSPFHPKINTCQFFTISANLASLYKPMCYQRPQSACVMSLLSGFAAAVKCQVKMPWKIYTTPQQKKGQEMVKC

SEQ ID NO: 782400 - protein, 112 aa, Homo sapiens
MLPRLVSNSWAPATHRLGLPKCWDYRREPPRPAGRWDFNSPEAPHAARCQPTLQPCSPAHTQKPPEASGLSPHCPAAGLACPHHRACSATEQKRHGQGRSGQDKALPPQAGV

SEQ ID NO: 782401 - protein, 110 aa, Homo sapiens
MAPAQKWLTWISSASRQEQRVTEDRPLWGESGALNSCSDSTSESFCLRSLCVPLLFYSPMAAAGSAELTSKAAMKFKRDSVSKDIHRELSTTLISGTIISRGSGKLMQTL

SEQ ID NO: 782402 - protein, 127 aa, Homo sapiens
CDPAKRPPGKSPAGAVGAMQEGAELGWKQALSAADGGSQDAMGLRCPLPTGGARQPEELPLPDAEPSLLTAMEEAGDPAGPRLEGWAWSMHGCGVNASGDLELGSPLFWDTCGRPAAALGIHTWKVG

SEQ ID NO: 782403 - protein, 407 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782404 - protein, 407 aa, Homo sapiens; identical to SEQ ID NO: 782403

SEQ ID NO: 782405 - protein, 407 aa, Homo sapiens; identical to SEQ ID NO: 782403

SEQ ID NO: 782406 - protein, 407 aa, Homo sapiens; identical to SEQ ID NO: 782403

SEQ ID NO: 782407 - protein, 427 aa, Homo sapiens
MRGLSGAWKSRVCRGAVCGCPATSSEGRACPLLPAFGWEGLLWGLLAPTSPARMRGRRCWPFMSVSTHVSGATGSPEAGIQTPALELLLPACVWPWECWGSSLSQTAAPRSSCCPCTSPAQGGRTLCESLGSWEQAVPSEDHRGAGPGVRADATLSFQVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782408 - protein, 427 aa, Homo sapiens; identical to SEQ ID NO: 782407

SEQ ID NO: 782409 - protein, 173 aa, Homo sapiens
MWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782410 - protein, 135 aa, Homo sapiens
MYTGLFFNLKRGFLSPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782411 - protein, 380 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPGSLLTRTPKGPQRTPEGLLSAERLPPAEPLEAPPGSPTQDPLGDASVRARLTLTPAYPSPLNLLTLEEYFSPKSTLDTF

SEQ ID NO: 782412 - protein, 206 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVSFSPPRQHCGDRAASAQAWAFLGLEWPSHRCTGLSGWELAVSYFPNACALRKGGKPGLCLHGHFVSQ

SEQ ID NO: 782413 - protein, 407 aa, Homo sapiens; identical to SEQ ID NO: 782403

SEQ ID NO: 782414 - protein, 407 aa, Homo sapiens; identical to SEQ ID NO: 782403

SEQ ID NO: 782415 - protein, 391 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAAAAALDEGRTTTCKGSTPTDASPRRRDVCTAQTQDSKLVNS

SEQ ID NO: 782416 - protein, 427 aa, Homo sapiens
MRGLSGAWKSRVCRGAVCGCPATSSEGRACPLLPAFGWEGLLWGLLAPTSPARMRGRRCWPFMSVSTHVSGATGSPEAGIQTPALELLLPACVWPWECWGSSLSQTAAPRSSCCPCTSPAQGGRTLCESLGRGNRLCPRKTTCGAGPGVRADATLSFQVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782417 - protein, 510 aa, Homo sapiens
QVQPVGEPGCAQRCQCWAGQPRPRGSKDMARKRCGCRQTGDWWLWTGPCRKRWGRGQHVLLYIVSTPPGGCHGPQGLAQGYGARHSSVLATGSGAPSVAAAAAMNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782418 - protein, 886 aa, Homo sapiens
LVTLRSALLASPLQVRWVPCRRVLSLDGSRPSLRQMAALRTPWVCGVPYPLGGLGSLRSSLFLMQSPHCSLPWRRQEIPPDPAWRAGPGACMGAGSTPQETWSLGAPCSGTLVAVQLLPWESTPGRKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVSFSPPRQHCGDRAASAQAWAFLGLEWPSHRCTGLSGWELAVSYFPNACALRKGGKPGLCLHGHFVSQEGGWAVNQPDSLQGGRPIPLGTPWGPVSEKGSYTETGFSVAWASQPHRADFPLGRWENARAPLSPVPEGAGTAGGGRRGALLVTQGRGVWSPQGPAGTPAVPRRSHSEPRQQDSPACLSTAHVHQVVPEGATGLEPGMRGLSGAWKSRVCRGAVCGCPATSSEGRACPLLPAFGWEGLLWGLLAPTSPARMRGRRCWPFMSVSTHVSGATGSPEAGIQTPALELLLPACVWPWECWGSSLSQTAAPRSSCCPCTSPAQGGRTLCESLGSWEQAVPSEDHRGAGPGVRADATLSFQVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 782419 - protein, 274 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGC

SEQ ID NO: 782420 - protein, 245 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGC

SEQ ID NO: 782421 - protein, 138 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGPETLGASRRNLLSVFLFFV

SEQ ID NO: 782422 - protein, 71 aa, Homo sapiens
LSVSLLSYGMIGFMWSIGRLAYPDMSVLNLWGIVAGMIALSLGQDDGSSSPKRFRRLEPRKTVLGSLVFRD

SEQ ID NO: 782423 - protein, 47 aa, Homo sapiens
MGKAKFSGVQIFLTTPPTGMHVTLRPRHSCKFQEITFYSHHATVHSG

SEQ ID NO: 782424 - protein, 41 aa, Homo sapiens
YRINHHKSTAASNICKSDLDFRKPDTNISIGIYPLDSYARC

SEQ ID NO: 782425 - protein, 96 aa, Homo sapiens
EKPIIVRWEKEDRIINPEMARYLVSTKEVGEEVISTLQILPTVREDSGFFSCHAINSYGEDRGIIQLTVQEPPDPPEIEIKDVKARTITLRWTMGF

SEQ ID NO: 782426 - protein, 146 aa, Homo sapiens
RQGLPKAPGWTEKNSHHSWEPLDAPEGKLQGSRCDNSSCSKLPPQEGRGIAQEQLFQEKKDPANPSPVMPGIATSERGDEHSLGCSPSNSSAQPSLPLYRTCHPIMPVASSFVLHCPDPVQKTNQCLQGQSLKTSLTLKVDRGSEE

SEQ ID NO: 782427 - protein, 109 aa, Homo sapiens
GSQNKFVVGSSSNNVGHGSSTGPWGFSHGAIISTCQVSVDAPESKSESSNNRMNAWGTVSSSSNGGLNPSTLNSASNHGAWPVLENNGLALKGPVGSGSSGINIQCSTI

SEQ ID NO: 782428 - protein, 118 aa, Homo sapiens
YTFVQRMKILFLCQSYQQTWIFIKCCECIISFNYHTNMQNSDIIPIVYNCAVRSHDCMEELAFQQLCCAASLIIHFTLNLVSCFFNQIFRRLSFWLIIYYIHTHTLHLVCVSNFILKD

SEQ ID NO: 782429 - protein, 102 aa, Homo sapiens
YTFVQRMKILFLCQSYQQTWIFIKCCECIISFNYHTNMQNSDIIPIVYNCAVRSHDCMEELAFQQLCCAASLIIHFTLNLVSCFFNQIFRRLSFWLIIYVYV

SEQ ID NO: 782430 - protein, 32 aa, Homo sapiens
MRRMQRDGVQSCAAATTLSSLVRYSDLLTSWQ

SEQ ID NO: 782431 - protein, 114 aa, Homo sapiens
MYGTACENYRFQGRAPFGTGGLTVRANQVWKKLPGEDPHLHGMPPSWGWLAQLTHGGTTSVLPLPNSRAHVPLCLAHKHAHRVSICLMFQGPSHVMEGTWAGTISACTWAGARR

SEQ ID NO: 782432 - protein, 136 aa, Homo sapiens
CYLPISIYPKLRRLPFLLIKHSATTFSAYYASDARMDKTVPTLKDNASSEVRDKPINSAEGISAVCGKQSNEGSEDGKGRVPGGFTFNWCLERLISLTVPPPKSNTPTAQSNLIKIRKKFAFSFHCTPSNHRSSSN

SEQ ID NO: 782433 - protein, 42 aa, Homo sapiens
QEANSSSMELASETKSDSLFLEWVSLVSMTCPFNHCAIFGFS

SEQ ID NO: 782434 - protein, 163 aa, Homo sapiens
VGFLFIFKVESSRTEESQSSAEGALPGPLLGRAHLEPGRRAMKMQTRTSARPRGETPARQELGQVRPGRGRRGRGGDPESRAAGERPPTPGRGEGHRRWRRWQTGKRGLKLRGPSGFVPSRAEPSFPEKPIRSPTEESSDLRPPPGGGSEGAGPSAWSSGARR

SEQ ID NO: 782435 - protein, 123 aa, Homo sapiens
PLHLPTLLPPPPEPSPPTSPCSHLSWLTMPSPWSPGPCCPFLVSSKISSFSGALFCLTHLGSSCPQDPSPDPGAPLVPAVSAAAAFSSLCTFLFPCGPFSGRNRTFPHGSSRESRREQGNKPA

SEQ ID NO: 782436 - protein, 89 aa, Homo sapiens
HKASLTDPILFEAYFGLNELAEGIPAFLHHVLHLQVGGGCKVVDDVPNSEFQGARVAGEEQVGHDACTVHQGDLQLRAGVQQELVPQEG

SEQ ID NO: 782437 - protein, 35 aa, Homo sapiens
MGVVTTAGLGPTLTHTAHAASCLSTKSPLCLHPSP

SEQ ID NO: 782438 - protein, 91 aa, Homo sapiens
TQGRLKCRRDTARCRWALGADGAPSGTTTYNGMATRPKPKLEQIKRALDSMQRSVGSFLKMGELQRFWRSHDHDWPVFRMRALLADGEGTR

SEQ ID NO: 782439 - protein, 105 aa, Homo sapiens
MEFSGQRSCLSLCRRAGERRPGGSGWRSGRAPRGPRARSSRLPWPPKVPRLQPLPGRHPVWEVRSVSAWPPIVWDVRSPSAWLPSLESEERLHPPPSHLGSEERL

SEQ ID NO: 782440 - protein, 158 aa, Homo sapiens
HNPSHTSGTHIRNPHTSGSYTQALTHLRNPHTTPHTPQGLTHNVDTPQGLIHKPSHTSGPTQFITLLRTHIKPLTHLRGPYITPHTPQDSHTILSHTSGLTQPLTHLRTHTQPLTHLRTHTQPLTHVHLIMGSWGCNTTPRSPLPKSSPNDMTYTPTQ

SEQ ID NO: 782441 - protein, 121 aa, Homo sapiens
TQQWASRCQACGGQGFSTVAVLTIQAGSFFAVGAVLDTVGCLAAALASSSPSLPSCENQKCLHTLPHIPWLSAICLSGGVKEHSWPWARRMRNQSKETKAQGLTRQCTSNCQHFSACLPPI

SEQ ID NO: 782442 - protein, 70 aa, Homo sapiens
KDSMDLSDEISGYRSVDIHYLMDHIVYPAADIVDSPLVFFCYHVNSHTLMAKPSTSTNSVDTGGKVTVDN

SEQ ID NO: 782443 - protein, 102 aa, Homo sapiens
MAAINWILISMSRGVPPCVHHHHKPRASTARGLPMIRSSENIRERLSLQSTLQQDFRTLNFRFIISQLRRILPHSWNSAPIGTLKVKLTRKVSLQKKITPLM

SEQ ID NO: 782444 - protein, 71 aa, Homo sapiens
VIQTQDSQDPVSFLHFGLLPPPHWVSWPPIQGPFPCPGGPRFCWPAMRGASELAQLGSWMSGRATRPLPLP

SEQ ID NO: 782445 - protein, 150 aa, Homo sapiens
LCRAHRVPSISFHHGLPFLENTDGRPEEWSCRNGAGITAHLLQPSLLAGRPIAHSRLPISLLIRAPDLLGLLALICSHLTPCAPERMCQEILQTQRTNSAAFPTSTSAVLHLSGLRAWQDTWQGKSISWRASSEYPSQEHQQLTGKQFQL

SEQ ID NO: 782446 - protein, 72 aa, Homo sapiens
GAPQNDTIAGGRRKAPPHTTGYRALGRAPRSLDLPKPAVLEESNGSGAVQKLTSRATWRTMEGLLVALAEQL

SEQ ID NO: 782447 - protein, 109 aa, Homo sapiens
MEKFHFGGSVGVAPNRQDLGSRWGNPHVSPSESLTSPPAPFHSSACDTSGLSGWTPGHPPVLCSQTVNFVRENPSLGWCLRDGWLGVSPGPVRDHKAANFTGPFFSLQS

SEQ ID NO: 782448 - protein, 105 aa, Homo sapiens
LRMEELNMRVALTPETGKDRRRGPKSGPLWAPLRAVSSISHQRPTWKLPFPHLSPGPLPRSPDVWSPTALAGGGHEFHSERTVPGSNPSPTFYGPYYPGQSSSIS

SEQ ID NO: 782449 - protein, 114 aa, Homo sapiens
AETWLIMERAEHIRVGLTPRRTGIRTGVRGVPGYELSVCPLLAKSSRYQNNIASWKLPFPHLSPGPLPRSPDVWSPTALAGGGHEFHSERTVPGSNPSPTFYGPYYPGQSSSIS

SEQ ID NO: 782450 - protein, 36 aa, Homo sapiens
MPTVSSFPTVALFMFQSPLQGPHQDSPPPMLSSDAL

SEQ ID NO: 782451 - protein, 51 aa, Homo sapiens
MGGGEKGGNKGDTEAKRASDRHKRWRNTRGTNQRGPTREAAKTYEKRGHAA

SEQ ID NO: 782452 - protein, 88 aa, Homo sapiens
IRSHSLTPSSGNGHMTQDSPIKFNPRTSTETFNKVISAQGLADLRNVGNELLPAIFPPPGERLPENEANIEESRTERRQREASPDDIT

SEQ ID NO: 782453 - protein, 76 aa, Homo sapiens
HGEGGLVNKCYKARRGSHYQRESAGKTEDKEVGIPSNKKSLCTGREAAKPTWMRGEGQEPLSLETKESGVGGEGRL

SEQ ID NO: 782454 - protein, 40 aa, Homo sapiens
LRSRKILVVISDGAPQMSAFFLLIPVRHLAQPELFQIRFC

SEQ ID NO: 782455 - protein, 122 aa, Homo sapiens
MTGHGLRYISLPLPAPPVNIQLHLELTWEMQNLSKEGTQSHMIQKYESMSSKLWERIKKEETRNWDQPQGPRVVPGRANFPWTLSQFTQYELALAKLRFDYTEQAGSQVSVTCWGKKVCLTQ

SEQ ID NO: 782456 - protein, 163 aa, Homo sapiens
LLCLLRKLEVQDPGVHKDTRPLKPLGEDTSLPLSASGGSRHSLACSNVTPVPFSLSRGLLRASESSPLLFLVFETESHSVAKLECSGMVLTHCNLSLLGSSDSCLSLPSSWDYRRAPPHPANFCSFSRDGVSLCWPGCSRSLDVVIRPLRPPNLSSSYKRTNR

SEQ ID NO: 782457 - protein, 109 aa, Homo sapiens
HVFNIEGVEVACFSPNPTSLIQSLAQSTVRSFQAHYTQSCMETIVDTVEEKKSGKITPLKMHCCHIKSCESHQAQNLCWRKLCLDVVHDFTGFMKEATKEIMKEIVDLT

SEQ ID NO: 782458 - protein, 156 aa, Homo sapiens
NISLPHSLHYGVQGPHNMLVHGQALPQSILTLCYSRHTLSPDPRQPATPKHTCSFLIMFIPFLSSKAPSTPRGPAFHITTFLKGMALFISLILPATYTILLSSQQLTPHFLFLKCALLSNRQQNDTMSPQESNCLASISPLYRRQCWTPYNKITWA

SEQ ID NO: 782459 - protein, 69 aa, Homo sapiens
MLGLWCQRDLSLSPDSITYLLCDPGQVPPASVTCWGNSSAYGTGLCGGCKRSGRDHPSKWDRLYSMVMM

SEQ ID NO: 782460 - protein, 87 aa, Homo sapiens
MALGSAQWTVACTVTPFILRAPGPGGGSSPLPPVRAPEKEALELGAELGVGVRAAEADSQLSLDLSFPRISAFCYPCEKKPGEHSYP

SEQ ID NO: 782461 - protein, 114 aa, Homo sapiens
MLKKNLEVGIRKKIEHDVVMKASKQPAQEAGTAEGPSQEERGSCRHLLQDTFLRTLAPVQANIAPRRVERSTRRVERSTRRGGTVNAKQNKNIYSCRTGAQHIEKLLPAFLTAN

SEQ ID NO: 782462 - protein, 122 aa, Homo sapiens
LCLYILDGVTGLHLEGDGLTSQGLHEDLHPTSETEHQVQGGLFLDVVVRQGASIFQLFPSKDQPLLVRRDASLVLDLCLDILNGVTRLHLESDGLTSQGLHEDLHPTPSGGAPRAPPDGVEL

SEQ ID NO: 782463 - protein, 82 aa, Homo sapiens
LIEHEVDLCRKECPFVIKPKIQRPNTTQEGEEMETDMDVADVAMESSPGSSISMEHRLDVELRASGSSSSTNISSGPSPGPS

SEQ ID NO: 782464 - protein, 197 aa, Homo sapiens
LIEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGKL

SEQ ID NO: 782465 - protein, 41 aa, Homo sapiens
MLNFLKKAIQDPAFSDGIRHVMDRSLPTSLKHITPRTWEPL

SEQ ID NO: 782466 - protein, 77 aa, Homo sapiens
MRPPYTHTPARELGLLGLGTPFPRPIRGWKIGVPGVARVDPRRDRLPSPGSRKQSPAQQTCYWKSEGWVAPPVPTSS

SEQ ID NO: 782467 - protein, 69 aa, Homo sapiens
EIVAHIIQKILLSGSETVDVLKEAYMLLMKIQRLHPANAKTVEWDWKLLTYVMEEEEEFPYTGLLPTAM

SEQ ID NO: 782468 - protein, 46 aa, Homo sapiens
DPSTRSGADISPLGDSPQYLMILSSLTVAFVDNVLLAKGWNCLLLG

SEQ ID NO: 782469 - protein, 93 aa, Homo sapiens
MDTQKQIHKTHNSKNQFFTIFFFLSVEFGKEGTRKNFYLLLSIGHYGRKSRRADLGTADTADKTEPECFAASWTFDPNPSVTVSGAHSTAVHQ

SEQ ID NO: 782470 - protein, 75 aa, Homo sapiens
YSRGFALNLLCPCEAEAKKIEKQHKVTRTPNCPEHCKLIRRKEEEGRRAYSSIQPKALSKHPREQQGFVGNQSMK

SEQ ID NO: 782471 - protein, 75 aa, Homo sapiens
SPVLAHGPGVTEDSSAYPVRTSQLLVLLSSWKEEHLIGPTWVCISLPLQSVSVNMEAECLRKWTRRSILQLERRA

SEQ ID NO: 782472 - protein, 154 aa, Homo sapiens [sequence omitted]

SEQ ID NO: 782473 - protein, 160 aa, Homo sapiens
AIFQLVKSEAEEGGGCESREGVPHSVAQLAWGSQQWEHEEIKLWGLSRASSKGGPSQRQGVCWACVGVCWACVGVCWACVGVCWVCARHVLGMCRRVLGMCWACDGYVQACAGVCWVCAGHVLVMCGHVLVMCRCVQACAGMCWACAGHVRVCAGYVPGM

SEQ ID NO: 782474 - protein, 70 aa, Homo sapiens
GCGGCNALASGRSSLGLEPWTPVLPQVSEVPRKAFAMAPRVLLMRGSGIPGQGACFQDPLMRAQVAHDHL

SEQ ID NO: 782475 - protein, 68 aa, Homo sapiens
LAWAVCLPDVGPVGCRPLWKKAHQHLPTASSYPGRHSCLNLTVDPDLNFQPCSEAFLKSLLYTLRPEP

SEQ ID NO: 782476 - protein, 124 aa, Homo sapiens
EVCSAWRDITGLLKIIWKEGRRPSLIVLIDCKQLPLVLAPEQLRLFTRLWVRYKVYTTDYCMRKEERGLGRNTWGLPVNELAMTFTSRWPSRSLVTQVNHLSQPVDTMVDKVLRPRSKSLLCYI

SEQ ID NO: 782477 - protein, 109 aa, Homo sapiens
MAAWYSTIQIFHSLFTHSIVGGHLCCFQFGITIRQCCYEQSHVSLYVNIYVGHIHRSGIVVSWVIMCSALADSAKQCPKWFHLQALHGCPGCPISPPTLAIETSKRGSS

SEQ ID NO: 782478 - protein, 197 aa, Homo sapiens
DLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQREKKK

SEQ ID NO: 782479 - protein, 140 aa, Homo sapiens
EAITVTEKLEEEYKELPPESLKSQSPTGLPCTQNSPCVFPRENGVPSRTRVSLRLAMTDSPSHVGPGLSSASPCRKVCVPIPAACSCHTLSSSLGWKVPQPLLTPEPALTRGRQQASCAQDVLIPNSALWGHSNFLLWSW

SEQ ID NO: 782480 - protein, 135 aa, Homo sapiens
KTRVFSHSHSSMIPLTHTGFPHSHVVIRSHRDTHKSIHCHLCSGQGPQDPPPGHTHTQGCTGEHATNAHSCKDSRAHRHGGRRVRGGEADGAGGLRRERPRPDHCPCPPLQGSQVPSTLPVQGLARDPFPVLEKT

SEQ ID NO: 782481 - protein, 86 aa, Homo sapiens
QETLTLILCLETGYVVPKDKKPLEPLWIRSYQVLLMTPTAVNLQGLSVDLPLQGQGGTSTQQRTLKPVNQLETFICCSEFSSFTFE

SEQ ID NO: 782482 - protein, 113 aa, Homo sapiens
LAYIVRIKWDTTYQDLPYCYVVTVPASPSPSAVIAIQEAWHQHLLLVRTYGSFHSRQKGEGSRHHMMREKEREEKVPGSFFNNQIWTQELRAISHSLPLPPGPAFNPRDQIST

SEQ ID NO: 782483 - protein, 74 aa, Homo sapiens
QRRSRCMESLSGMPGSGSAGRVCIAIISVMVTDTEQGHQPNHSIVEGHRTRILGGQESTATLRPALTLRKLKRL

SEQ ID NO: 782484 - protein, 81 aa, Homo sapiens
LHWLGRSSPSSSDLSDWLVSADSGATLKTETVLGPPSRALYSLVCFQSTLKAPCCFLHHSFTRSGGTTRPGLASCLCHSFT

SEQ ID NO: 782485 - protein, 127 aa, Homo sapiens
APCCCDSRKRQWFSPRHTHPQIELRLSQPSHFQDGKEGLLLSLFSHSSGCIYTQCGLRLSSPVRLYFMLILTSVPLCINVVERRSQSDAGPLLLQRMVLKGDFPPSSDFGASTYLWITIQSGNLRNN

SEQ ID NO: 782486 - protein, 49 aa, Homo sapiens
QPPQQWAQSAAIRVSAPLCKDWGPDAPSLEATSTTDHCSTENSIKTFYR

SEQ ID NO: 782487 - protein, 30 aa, Homo sapiens
MVPLGGYVFHTVIFSSKTIPSNENVHVKQK

SEQ ID NO: 782488 - protein, 36 aa, Homo sapiens
MTQIPGITFLHLEMPPRTPEDRPLQQHDANTTSHPK

SEQ ID NO: 782489 - protein, 112 aa, Homo sapiens
AHPGSRQLGTPMGVWNFFFWAAWFSPVDRGDSQAGRLSGSGDHESPDAAVQSSRNSETKMPGAGERARLSPHQEDQGEKVTPAPLLRGHFGRNRDVYLAASNNNNKNNTTTS

SEQ ID NO: 782490 - protein, 94 aa, Homo sapiens
LRLLHKQLFHLFLPTRIREVGWGSGIQLRTSKVCQKGLNFCPPCTTKIPMLIEEQIDVLPSLLILRGERQDPETLGRLWLSLSLSQRENSAGRE

SEQ ID NO: 782491 - protein, 76 aa, Homo sapiens
VNSGFCSGDVWAPIKLAACTGAGRARKQEPMQGGHWGQPRLMLGPHVSPPPTTLSKPQLSHLEIRGHSSAWHSSSG

SEQ ID NO: 782492 - protein, 79 aa, Homo sapiens
SPEHWRGMWLGQPDAAASTSGSFSASIASRDPSIWAQLTRPASRPTCRQFSQAGAQLRWRLGWVSSVSLSVYKGGTQVH

SEQ ID NO: 782493 - protein, 126 aa, Homo sapiens
RDSQTLEYPPAPRNPVQGRPELRSRGLHCGTWWGRGPTHHQQKQTQNHPRWMSTAWPHGTPWKTRAPQVRPQHNVTHPKETISATRDDSMQMEQICHLSMSETDRNLQGGSKTRIKEQEREGRMGR

SEQ ID NO: 782494 - protein, 104 aa, Homo sapiens
MGEQHPARATRMLRIWPASGRSVGVRPRATVGNQDVSCPGARHVPCIWFSGRPHPGLCPESLGWDTDGWDTPAWSCPGRQRRRGGLGCFQPHLDNRRTEPPPSP

SEQ ID NO: 782495 - protein, 130 aa, Homo sapiens
PGAGDTSDLKYPLATRLREALTEARFHQLFRGEEQEPELPEERGFPRLFGLWRLRARACSGTGAWRLLLARLPALHWLPHYRWRAWLLGDAVAGVTVGIVHVPQGMAFALLASVPPVFGLYTSFFPVLIY

SEQ ID NO: 782496 - protein, 108 aa, Homo sapiens
SLTLESAGSMQDAIRWTTRWNEKIPPVTWHVKEEPGPGPGQPGMRRPREAQGPRRGVATGQPCSPSPAHVSPAHPGLALLTWPCLSSLAHMALYTWPFTHSPAHPAPS

SEQ ID NO: 782497 - protein, 246 aa, Homo sapiens
FSRQKVSNLYRPTESNRCLYIPPPRTSEDPEWQLVLAGLFLSMCLVTVLGNLLIILAVSPDSHLHTPMYFFLSNLSLPDIGFTSTTVAKMIVDIQSHSRVISYAGCLTQMSPFAIFGAWKRDTLLSVMASDRFVAICHPLYHSAIMNPCFCGFLVLLSFFFFCLLDAQLHNLIALQMTCFKDVEIPNFFCDPSQLPHLACCDTFTNNIIMYFPAAIFGFLPISGSLFSYYKIVSSILRVSSSGGKY

SEQ ID NO: 782498 - protein, 83 aa, Homo sapiens
TGSMARMLATDYVYNRERGSICCVQGQRRQTRWPLSGGGSLVYQCRKLPIEVGAMTETPGKVMVEDGGDLLQMGCSGRASLRR

SEQ ID NO: 782499 - protein, 207 aa, Homo sapiens
GQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCV

SEQ ID NO: 782500 - protein, 139 aa, Homo sapiens
MLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCV

SEQ ID NO: 782501 - protein, 70 aa, Homo sapiens
PQESREEWTELPAGAEGGADGVTCRSRGRSGLSYLQESREEWTELPAGVEGGVDGVTCRSREGSGWSSPH

SEQ ID NO: 782502 - protein, 119 aa, Homo sapiens
KEQDLNIALSNLFLTLLQMVCKFYLKTSASVLPAFKLVQLHQPLSLMCLPFTQCWAGEAAVQENLTKSFLLSEILPLCPHPRYNFRKEMRCKTKVSLASMHCQYLACEMSMTSVLFPKD

SEQ ID NO: 782503 - protein, 67 aa, Homo sapiens
FTVVTFTGKGIECPGLDNRGDSFGTGKAVVKKASHIHVVSWPDRRLSARKGEVCISSFTYTFSMSIY

SEQ ID NO: 782504 - protein, 89 aa, Homo sapiens
TQIKAKSKNGKIKSSFSKGSYPKTFFLDRPHGGAMNTTIHTSQGQNKIELPLEKKTTAATIVQPTGIQSVHTAKSKFPLSGSSWEEVSA

SEQ ID NO: 782505 - protein, 69 aa, Homo sapiens
KKSQMKVIKKAGEAVIQSTQSSGFGWEEGWASAFLCISGFSGNGLRVFLSGNSHSLCEDKRYYGLHFST

SEQ ID NO: 782506 - protein, 98 aa, Homo sapiens
PHLPRPLLPLVSPTISSSAAAPGPSSSLLCGGVFLSPNPAPVLCVCPPVLAEGTILLGAGATLHLCCFVVGVDSAQPALLFLFVAVLGFGVCCPEGEG

SEQ ID NO: 782507 - protein, 149 aa, Homo sapiens
GPLRKSLAHVVCHRDSVLRSAPCSAESRGFELRTPAPCTLPIPPNWPQPLKLLLSVLHSSGPEPVEVQLGVMNEPRAWGLRPGVDLQPKLETLVEPSRIFRSQSSWPLPNPRECPFQGEWVLFAKFWLLCGKPGPCTRLRAKQGACDLP

SEQ ID NO: 782508 - protein, 117 aa, Homo sapiens
MLLEPGHRASVRGEVSSLSWQPCAKEGLWVRQLGHATAAGCLSLSEAPGPTAAVACLTSCQRRLQSHVPSCVDSKGYFKQGRWWETGSVPATRSFASFKERGWEPDVPGDRLRSTEQ

SEQ ID NO: 782509 - protein, 95 aa, Homo sapiens
MPSSVVAVWHGSCLVWGLSSVEGVWSGRCLMWGPSSVGLSGVGAIWHGSCLAWGLSGVGAIWRGCRPMWGLSSVEAVWCGSCPIWGLSGVEAVWC

SEQ ID NO: 782510 - protein, 99 aa, Homo sapiens
QFNCLCDEDIGKEFLTDSLFTLASPSRGIIGALPNLHSLTPNMCWAGKKGCNLAGWFPDLALHQPGRSLLYLLFCVQGDTCLGLPEISLAGKFHRFNLV

SEQ ID NO: 782511 - protein, 104 aa, Homo sapiens
PKLWTKDFPSYFAASNCRHKKKEREREREKKHIARKAAVNFYVTVLIVFAQKGVLEISLQLQRKGPISLRSQQDVHLLHSVALFVSLFVLHLILESTFFSAAFT

SEQ ID NO: 782512 - protein, 80 aa, Homo sapiens
MYSQRDPKSEGTAIWAGSLILCSAGRNGRNVVQNETDIPLTFRCFDHTPSEPHLVGCGPRDHPPPARLETKNPHYALSQT

SEQ ID NO: 782513 - protein, 105 aa, Homo sapiens
FSFFPRHLSSNILNSLRIHYTHCLLSIHIFLYQRTTTNTEISSMWAGIFVFHQHYFKYIEQYLANSRGQKKILRYEYINPTQECAIFSKNLSSLDSGREGHKMDN

SEQ ID NO: 782514 - protein, 80 aa, Homo sapiens
LTLNQDTQLPLSHGWALPNTGLATPRGNVTFVLELIVLLWLLTGLFSSLVAKQMSLPCDRFINKQTHFSTLDNYRMHTMS

SEQ ID NO: 782515 - protein, 74 aa, Homo sapiens
GWEADIAGRKELECWGLSTWCHVLPSAQYGGNISLTCQHLPGYQYQLSGIKRSFSKSLCSPGKLKGQSEVRGGL

SEQ ID NO: 782516 - protein, 102 aa, Homo sapiens
GKHIEQLQCILGGSHCRPRTTSNCIMYAQETRAWQTRWQETEYRELSNPSSGPCEASSPPEAGSEPGPFLQRAAGRIMWLAGGGGTKRSTGKKGMATRSGIP

SEQ ID NO: 782517 - protein, 45 aa, Homo sapiens
KSLTFVVFVGKVFVMEVRIDFTYEYIMMIKDMSAMNVEKHLSVMI

SEQ ID NO: 782518 - protein, 92 aa, Homo sapiens
CHAPRRSCPFPYGGTPGCPSPLLINDSHHEYPSSRIPVGTAGSGLVKTHRPHVLTAQLHVYHLHWTLCVPISACVRCCQLLCLVAPPRSCRR

SEQ ID NO: 782519 - protein, 81 aa, Homo sapiens
AGANLAQTSRHRCPDFLDLMTPPAPTASLWNSQLQTAQRSHSLHLISAKRPRSDENSHFERTNSPNSPETSHSAHSTKTAR

SEQ ID NO: 782520 - protein, 232 aa, Homo sapiens [sequence omitted]

SEQ ID NO: 782521 - protein, 246 aa, Homo sapiens
MTPWSHGKRTLTLPQNSKNRSPVASSRRRYAKRRERRMQCPHMLKEGALGAMAYGADMAKSKNHNTHDQFQKRHRNGIKKPQSQRSVSLKGVDPKFLRNMPFAKKHSKKGLKKMQANSAKAMSARAKAIKALVKPKEVKPKIPKGVSRKLNQLAYTGYPKLGKHACARIAKALRLCRPKAKAKDQTKAQAAAPASVPAQAPKGAQSPYKGFRVEISVCQREDRRTGATPPGCHRHGAGVLLCYLYK

SEQ ID NO: 782522 - protein, 195 aa, Homo sapiens
MAYGADMAKSKNHNTHDQFQKRHRNGIKKPQSQRSVSLKGVDPKFLRNMPFAKKHSKKGLKKMQANSAKAMSARAKAIKALVKPKEVKPKIPKGVSRKLNQLAYTGYPKLGKHACARIAKALRLCRPKAKAKDQTKAQAAAPASVPAQAPKGAQSPYKGFRVEISVCQREDRRTGATPPGCHRHGAGVLLCYLYK

SEQ ID NO: 782523 - protein, 195 aa, Homo sapiens; identical to SEQ ID NO: 782522

SEQ ID NO: 782524 - protein, 88 aa, Homo sapiens
KNGYKVHKNHTNSHFFNCNVLKELAVVLIPHSHITPNLGGKKNGSQDNPLPVSWTNVDISITYKSFYVNLQNRALAFDLAQFKCQEFL

SEQ ID NO: 782525 - protein, 152 aa, Homo sapiens
GGSLRGQDCAECSLADDGRGGGFGRGGPGGEACPAHCLLSVARIGTCMGPGNVVLTWGGSPPPGLSSQRHCYRGRDSAAASERSWAPEQHQAWDGPSVPSTEDASVRPGSAGTVYLSALHAADHCAPPPQTVPMDAGAAVDDGAAIMDNGTA

SEQ ID NO: 782526 - protein, 79 aa, Homo sapiens
MAGGFHGLEHWLSLALATQAAGRQPSAVIAGRSRVLLKLICLFQKTLSQPVQRLACQGLPSLQLSSLVKGHALAILRQL

SEQ ID NO: 782527 - protein, 44 aa, Homo sapiens
MGLGNELCFRSGLGRQMGEAGLRAIPPPDQGRGVPKLLGQPRRM

SEQ ID NO: 782528 - protein, 85 aa, Homo sapiens
GLANKERVPSWQDWRVGFHSLPPGHCLPPEPPQPQGGFRTVLDELGTALSQLRQQGDVLGSLTVLRVRVGFRKEITQETRKVRLL

SEQ ID NO: 782529 - protein, 105 aa, Homo sapiens
PSGRNEPSGRNEPSGPEQNSDKGTTCQRGFRLEKRHPKDSVKLAHISLFALFSSFLQLYAPDLNIFSWSLLYFYLACLTLFIIFGKQIISQSSFLISNIPIIIAI

SEQ ID NO: 782530 - protein, 43 aa, Homo sapiens
MRSHSKVGSGWIPGKLHYKTGRKTPRWIDLSIECHSADLMRYF

SEQ ID NO: 782531 - protein, 81 aa, Homo sapiens
AESQLGLSASTIITLGLQRAKHRAGQSSHLSRKNPASLTESTIPTRGPVSLTANHTTLGFGFQQKRRCQVEHVTAPPAAGA

SEQ ID NO: 782532 - protein, 96 aa, Homo sapiens
SHHLILMKSHLLRYIASSDGDRTHVHWKKSSHLLRHPDGALPSGSFILRALKSPDPTIHAGQSRTLLLTLAALETTAPQCPVRTLLLTLAVLESMA

SEQ ID NO: 782533 - protein, 239 aa, Homo sapiens
LKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVF

SEQ ID NO: 782534 - protein, 67 aa, Homo sapiens
QNTAARLITPAQEDRTLLPASSPQPKRTEHCCPPHHPSPRGQNTAARLFSSQLPKTSPATTHPSPKV

SEQ ID NO: 782535 - protein, 126 aa, Homo sapiens
AAPPGMTATASDHEHLLTRRGWMFPRKVYLCSFSLFSLKHSYICAIWLIMNLFFSINVLPPCPERVCVCEIPSNKTAEPACLISGTVSQLSESKLLRKMQHLIRTCFKYQNLQLSGTGLSQDVFAG

SEQ ID NO: 782536 - protein, 92 aa, Homo sapiens
DDGGRPPGSGRSQAVLLDQQGGDGEDSRKPLGFLVQDEIAQEIRTQQRLRAAPGAGLAGGAPSRQLPCGAGRCFWAVTWPGLAAPGSVCAVG

SEQ ID NO: 782537 - protein, 78 aa, Homo sapiens
KPQCPPQSLGAPKGPSREERNKLTLLVAALSLRCHSVTLPWALTTSFPCSTPHALLGLPAPIFPGELSRYHAACLTLE

SEQ ID NO: 782538 - protein, 148 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLV

SEQ ID NO: 782539 - protein, 104 aa, Homo sapiens
RSRPCPRNLACWPGGGASEPRRFRFTRPSRRPVPSGSGHSDTFSFGKGYGVAKGRRGPEGFGKRWGRGQRIPVEAPPSPNISILESLSFFLGPAFALSPQVNSR

SEQ ID NO: 782540 - protein, 104 aa, Homo sapiens; identical to SEQ ID NO: 782539

SEQ ID NO: 782541 - protein, 104 aa, Homo sapiens; identical to SEQ ID NO: 782539

SEQ ID NO: 782542 - protein, 76 aa, Homo sapiens
RSRPCPRNLACWPGGGASEPRRFRFTRPSRRPVPSGSGHSDTFSFGQLKVDSVATGEVGEQALFQLRGKQAFTGVP

SEQ ID NO: 782543 - protein, 31 aa, Homo sapiens
MWVWSVASLLQDFPIALRKKARVFALLLKTL

SEQ ID NO: 782544 - protein, 154 aa, Homo sapiens
SSCQNRTVNSNPLEPWPWSSTNAGGSVQNMRPSVTKASRFSRISVFTQGDCIGSSKCANAGRISRPGMALYAPEMCNQVTSSQSIPNLLPCSAQQQQEQQQQQLCALPPTPQQQPPLNNHMISQTDDLSKSFRQMSPSCQGSTKATDSSAALFQ

SEQ ID NO: 782545 - protein, 71 aa, Homo sapiens
NASSSTEVSTARSCPLPACQALCLLHCLAPSSGGCEGLAPNMPVAAVPKPPSDPEGMGLAAVAGERSSSQS

SEQ ID NO: 782546 - protein, 81 aa, Homo sapiens
QAGAARAGWGEVRHAAWLTHIAEYRAHKAPSSTDTEAAKTAATRQPKGNVHLGASHNFSGKEVMSGKEPQPRASKLIPTSN

SEQ ID NO: 782547 - protein, 51 aa, Homo sapiens
LPLMKELRRPKVTHVTSFLWPATPKGEEERTREGGKAIAPGSGVPLPLPAQ

SEQ ID NO: 782548 - protein, 107 aa, Homo sapiens
VGPRPLTAEFRVMKRCKVPYGSLKVMARRGGTSSSTLFASTPRNKWVPRPIYSSYWGTCYIRIIDPVHTLYLGVWHPILVEFAYELVFSCTFSRLFQCSIKLTNSKW

SEQ ID NO: 782549 - protein, 107 aa, Homo sapiens
MVSTGPAHRALRDLSRPSSYLTEASPGRFSLSSGSGDRSAPPPQWPRLGRSCLLQPLKAQLLPLSGFCAPKCPPVSLSWLSSCVLAELLPPVGLYKPSLCCMVASSG

SEQ ID NO: 782550 - protein, 929 aa, Homo sapiens
KASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAGETLPLPLGVISPQESLEEGGGGIQFTALVLAVVETEGTGTERLYTSSSASVFYGGPLGDTEDREALISLTQACLSPSSGSWVQPHTPQSLLATLMPLPGKPHSGICFGVGNECNAMPPPTEMWTAVSIKVYEGVIFICYGGDGSKGSEEGLLSRVYGWGESILSLTPHLYPQELRELDAMAECKAQMHLLPSPPEPRLCGLSEGPQAWLLRRQSRALLSALQRSSPVWVPESRRGAQLAERRLRQRLVQVNRRLESLQDLLTHVIRQDESDAPWSVLGPNARRPLEGVLETEALELSQLVGTLQRDLDCLLQQLKGAPPCPSRRCAAVAHALWTGRLPLPWRPHAPAGPQPPWHWLRQLSRRGQLLVRYLGVGADASSDVPERVFHLSAFRHPRRLLLALRGEAALDQNVPSSNFPGSRGSVSSQLQYKRLEMNSNPLHFRVENGPNPTVPERGLLLIGLQVLHAEWDPIAGALQDSPSSQPSPLPPVSISTQAPGTSDLPAPADLTVYSCPVYMGGPLGTAKLQSRNIVMHLPLPTKLTPNTCVQRRVHVCSPPLS

SEQ ID NO: 782551 - protein, 428 aa, Homo sapiens
KASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAGGEWSKSHGSRERAAADRATGPTCGVGPNSWSLAGQSFQPTQPSASRQHQHTGPGHQ

SEQ ID NO: 782552 - protein, 141 aa, Homo sapiens
QLLVRYLGVGADASSDVPERVFHLSAFRHPRRLLLALRGEAALDQNVPSSNFPGSRGSVSSQLQYKRLEMNSNPLHFRVSSRRPSFAVPVPSKSLITPRSYPFLVILPPVTLLASPISLHHDLLPANPHFPPATSQLPSLA

SEQ ID NO: 782553 - protein, 806 aa, Homo sapiens
KASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAASVFYGGPLGDTEDREALISLTQACLSPSSGSWVQPHTPQSLLATLMPLPELRELDAMAECKAQMHLLPSPPEPRLCGLSEGPQAWLLRRQSRALLSALQRSSPVWVPESRRGAQLAERRLRQRLVQVNRRLESLQDLLTHVIRQDESDAPWSVLGPNARRPLEGVLETEALELSQLVGTLQRDLDCLLQQLKGAPPCPSRRCAAVAHALWTGRLPLPWRPHAPAGPQPPWHWLRQLSRRGQLLVRYLGVGADASSDVPERVFHLSAFRHPRRLLLALRGEAALDQNVPSSNFPGSRGSVSSQLQYKRLEMNSNPLHFRVENGPNPTVPERGLLLIGLQVLHAEWDPIAGALQDSPSSQPSPLPPVSISTQAPGTSDLPAPADLTVYSCPVYMGGPLGTAKLQSRNIVMHLPLPTKLTPNTCVQRRVHVCSPPLS

SEQ ID NO: 782554 - protein, 44 aa, Homo sapiens
EVREGKWTQLQGKMLQEEKPGRGNGHNYKERCCRRRSQGGEMDT

SEQ ID NO: 782555 - protein, 81 aa, Homo sapiens
LQVLPDFALQLPVLRLQDPHSFQVGGQAVAQALHGLLLVLDASHSCQTPAIPAARPPDPKPPRKLLERNTEIREPEPPALA

SEQ ID NO: 782556 - protein, 147 aa, Homo sapiens
RGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDNTFA

SEQ ID NO: 782557 - protein, 159 aa, Homo sapiens
IAMFRGIAMYGETAMFGGTAMFGGTAMFGETALLGGTAMFGGDHDVRRDRDVGENAMFGGIAPVLPEASWPAGQAAAAGIRPGGKEPRRGTECLQPGMFGEIAMFGEMAMFGEIAIFGETAMFGEIALLGERAMFGEAAMFGETTMFGETAPVLPETSW

SEQ ID NO: 782558 - protein, 104 aa, Homo sapiens
HAGCQGSGGKLAVTGLTQLPHKRKGQSHSHHAPSTAPSLFPGSRGSGPENLPQATHLPAVKEKGLVLSPPMESAHRIRALPLLARRLLASSNCYKVQLETSFSL

SEQ ID NO: 782559 - protein, 388 aa, Homo sapiens [sequence omitted]

SEQ ID NO: 782560 - protein, 388 aa, Homo sapiens [sequence omitted]

SEQ ID NO: 782561 - protein, 388 aa, Homo sapiens [sequence omitted]

SEQ ID NO: 782562 - protein, 388 aa, Homo sapiens [sequence omitted]

SEQ ID NO: 782563 - protein, 163 aa, Homo sapiens
RPLLRLVALQSLQMGDNRLRALPAELPRMTGLRGLWLYGNRFEEFPPALLRMGRLHILDLDRNRLGGFPDLHPLRALRVFSYDHNPVTGPPRVADTVFLVGEGAVERMAERDEPTPRPPPRRPARAFEDEEEEDLLIGGAGSRALGAPGGSFRALEAAPGLGT

SEQ ID NO: 782564 - protein, 163 aa, Homo sapiens; identical to SEQ ID NO: 782563

SEQ ID NO: 782565 - protein, 125 aa, Homo sapiens
IQVDHGMLWPPVLYKDVGQELPVVSTAPPHIALLMEPFTSDVVSRLMGRIQVCKDYVLDQLWSVLSQKMSFLPLVARIFPKQMPNCTLMPKASICKTVKEGEENISLLGSYQRRENLDSVCSALF

SEQ ID NO: 782566 - protein, 147 aa, Homo sapiens
GVTLGQRLSVSLGVEVHGEERGAVLKGHMAYATPPAPTPGVASFPLTGEEAAVQGCPHLSSWRMWSLQKGDPVVGDLVQTTHCLLWAFLGLFGSQERRELRLWLLCELDTDAPAAGPSSVNGHREQGPRGCSRGHWQQLCSGLAILE

SEQ ID NO: 782567 - protein, 99 aa, Homo sapiens
PASASQSARITGTSHHTQLKWDPSFIPHAFKTSQAGILSASLLWYFQNVDHAWPLAFSWEVMRPSAEKDKQLMVTPCCACNSVTGEATSRGCRKQSSQC

SEQ ID NO: 782568 - protein, 107 aa, Homo sapiens [sequence omitted]

SEQ ID NO: 782569 - protein, 63 aa, Homo sapiens
RAYDKCFTCPISAVGDKEDHKPFSLWHGETFEQSLRIEQESADTGEAPTQSGGHMVCLESHQQ

SEQ ID NO: 782570 - protein, 113 aa, Homo sapiens [sequence omitted]

SEQ ID NO: 782571 - protein, 100 aa, Homo sapiens
MRICVEVTGARPKAQSVSIHPFEQLSSAMRTTSPRQWRLPQARRGVAAGPGGGGRKRARRRAGKTPRGTARAPHPKGRKAARPWAEERSSGRPEETRSSL

SEQ ID NO: 782572 - protein, 153 aa, Homo sapiens [sequence omitted]

SEQ ID NO: 782573 - protein, 102 aa, Homo sapiens
EEGWGGPFKFITRKLAWNTPPLSPPGYGEKAIKGIYTVAFPQRLRHLGRTEPTSLALDSGADELRTKPVHWTAARCQGNPDPEQAWGPRRVPMNPPPASCSA

SEQ ID NO: 782574 - protein, 114 aa, Homo sapiens
MLQKLSFGLPHPLSCTHMNPEPQTPEADQQARRPAEGWQNDVAEKGRRGGTSECQNEFSWGQSERSPATGQPESRGGSPFHFIPFLCLPIHPAESHLHHSIKPDAAENFLRRAE

SEQ ID NO: 782575 - protein, 110 aa, Homo sapiens
MAFFPILNEKMHFVLLSKSDMDRRRKYWVEKGSSLAKPHPQAWIPAVLNENENRHFCVHAPKVIFWPATPPILHPYESRTPDSRSRPASPQTSRRMAERCGREREKRRNI

SEQ ID NO: 782576 - protein, 143 aa, Homo sapiens
LQFLQLWPSWAFEHRLKTALSASRLWRFWNSNWLPCSSACRRPTVGRHLEIVDMDRRRKYWVEKGSSLAKPHPQAWIPAVLNENENRHFCVHAPKVIFWPATPPILHPYESRTPDSRSRPASPQTSRRMAERCGREREKRRNI

SEQ ID NO: 782577 - protein, 48 aa, Homo sapiens
QPSRSLGEHCFIPHPLYMFAALCGVHISFTHMISFNLFNELDITNPIS

SEQ ID NO: 782578 - protein, 96 aa, Homo sapiens
YLPSEQSGCVSQAGVQMVRSRLTATSASRVFQDSQEGAHIRRETVSKSVCAEPWRHQRARDPAPTNFPLKCQKQRGASTSSGQHGGRVNLVFFIGE

SEQ ID NO: 782579 - protein, 114 aa, Homo sapiens
MVRSRLTATSASRVFQDSQEGAHIRRETVSKSVCAEPWRHQRARDPAPTNFPLKCQKQRGASTSSGQHGGRVNLVFFIGDDYSPPSKRQRPTSHHSHQSQNLPMLEERKMREFN

SEQ ID NO: 782580 - protein, 47 aa, Homo sapiens
MEKHFESHTEALRSCCHLQLLSNHTVITRSLEREHLLHLTLSTDGPR

SEQ ID NO: 782581 - protein, 110 aa, Homo sapiens
MGKKLKLQEMTQPQTPGQSGTARGCAGLALPLHQQVPDLRVPPVWATYRKHGWGGFRKLTILVEAEAGRSYMAGGRGGAVPRTSRQPDLEKSYHGNSTKGGSCPQDPITS

SEQ ID NO: 782582 - protein, 73 aa, Homo sapiens
MPPVWTTFSTKQMGLIQSSCPNPDLQDPGQSLRPLFHQLGTQYYQLQDYCTCPICAGERGCLFNKPQAHLLGL

SEQ ID NO: 782583 - protein, 104 aa, Homo sapiens
AATRGGDSPPPPVGPGSSTRDRRGPESRVGQGRPLRVARKGHFTDWSSGASASCPARKTPRFEDRKAFKVRIGSPRLPQRGTPPGPALLGRGPRMLALPERLRR

SEQ ID NO: 782584 - protein, 104 aa, Homo sapiens; identical to SEQ ID NO: 782583

SEQ ID NO: 782585 - protein, 124 aa, Homo sapiens
SDGQRRCGRSETMPLPKKGPRSALGLPKPGPLCFAPPPHSRAARMDGWASEHSCSSGSGPPVPRELEEAFRALNQTAAEGVPVGRAPSPAQRQGHRFGAGTARYVFPRPLGGPHPPCLLPLPTE

SEQ ID NO: 782586 - protein, 1372 aa, Homo sapiens
MCTATPCLATWGSLFSLCRVVAESVRHQVPVTHWVDRFFENVSTDFLHERYIASSSVGSDMKSKGFPFKLGIAAEPQAVSDISTKPLREAGCARVRALPRHCSSFGAGHAWPGPLGRGGCGAASLASTHESQEHPLQFVTTKMSLDFASIPSGQSPFLGPQSEPSALPGLDLFLNSHKLQGAAAVSLARHWPITSNRLGRAPVESPVPSHFRRVALLPRSRSQWPDKQSHSGVVRPGRVSPVGGRGALARRVSGEAKCKALVRGASGSHGGAAGQGPAVTRSPSSLCLALCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782587 - protein, 1077 aa, Homo sapiens [sequence omitted]

SEQ ID NO: 782588 - protein, 1330 aa, Homo sapiens
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782589 - protein, 1607 aa, Homo sapiens
MKSKGFPFKLGIAAEPQAVSDISTKPLREAGCARVRALPGTAHLLGLDMHGLGRWDAVGVEQHPWLPPTKARSTPFICDHKNVSGLCKHPLGAVSPTENSYYRGRCVILRFLLEKLRSLVDEAEMCPLSEWPCPVLRGPVPESGGDQRGWAEAEVSTGHDFWKSRLPWSLKGQYKSAVERAGYPLDSSSLGEILSIRVPHGAPSERPREPTQRLPGTGTGATWVPLRPCTFPHLKEGRGPRASSAIAGDQVSYDENVWGSFSPAGSVSLLGKTIGKNVCFAFRISHIECALPSELPEVDGWLRFLVIRAAPTLQNVLVASLSVSRDVVSLRLLMFRGELWSSQATGSAPSGHSLALTEPGEERGAGAGGPSLELFSTVMVTGQRWRHSQPFLGPQSEPSALPGLDLFLNSHKLQGAAAVSLARHWPITSNRLGRAPVESPVPSHFRRVALLPRSRSQWPDKQSHSGVVRPGRVSPVGGRGALARRVSGEAKCKALVRGASGSHGGAAGQGPAVTRSPSSLCLALCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPWSPVPPRSPQGGISQAARAGPGLRKKGRPLASPGSVLGHRLSLRLMGDDVLPGPASCTGLHGAQLPDTLLSA

SEQ ID NO: 782590 - protein, 1657 aa, Homo sapiens
MKSKGFPFKLGIAAEPQAVSDISTKPLREAGCARVRALPGTAHLLGLDMHGLGRWDAVGVEQHPWLPPTKARSTPFICDHKNVSGLCKHPLGAVSPTENSYYRGRCVILRFLLEKLRSLVDEAEMCPLSEWPCPVLRGPVPESGGDQRGWAEAEVSTGHDFWKSRLPWSLKGQYKSAVERAGYPLDSSSLGEILSIRVPHGAPSERPREPTQRLPGTGTGATWVPLRPCTFPHLKEGRGPRASSAIAGDQVSYDENVWGSFSPAGSVSLLGKTIGKNVCFAFRISHIECALPSELPEVDGWLRFLVIRAAPTLQNVLVASLSVSRDVVSLRLLMFRGELWSSQATGSAPSGHSLALTEPGEERGAGAGGPSLELFSTVMVTGQRWRHSQPFLGPQSEPSALPGLDLFLNSHKLQGAAAVSLARHWPITSNRLGRAPVESPVPSHFRRVALLPRSRSQWPDKQSHSGVVRPGRVSPVGGRGALARRVSGEAKCKALVRGASGSHGGAAGQGPAVTRSPSSLCLALCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTESEWPAPLQGQWCCQRCTWVHGVALQGHLGGCLAAPTLTALLFSHAPPMSPAVVLHRGQLLGLRANKTSPTSGEGARPGGIIHVYGDDSSDRAASSFIPYCSMAQAQLCFHGHRDAVKFFVSVPGNVLATLNGSVLDSPAEGPWSPVPPRSPQGGISQAARAGPGLRKKGRPLASPGSVLGHRLSLRLMGDDVLPGPASCTGLHGAQLPDTLLSA

SEQ ID NO: 782591 - protein, 1606 aa, Homo sapiens
MKSKGFPFKLGIAAEPQAVSDISTKPLREAGCARVRALPGTAHLLGLDMHGLGRWDAVGVEQHPWLPPTKARSTPFICDHKNVSGLCKHPLGAVSPTENSYYRGRCVILRFLLEKLRSLVDEAEMCPLSEWPCPVLRGPVPESGGDQRGWAEAEVSTGHDFWKSRLPWSLKGQYKSAVERAGYPLDSSSLGEILSIRVPHGAPSERPREPTQRLPGTGTGATWVPLRPCTFPHLKEGRGPRASSAIAGDQVSYDENVWGSFSPAGSVSLLGKTIGKNVCFAFRISHIECALPSELPEVDGWLRFLVIRAAPTLQNVLVASLSVSRDVVSLRLLMFRGELWSSQATGSAPSGHSLALTEPGEERGAGAGGPSLELFSTVMVTGQRWRHSQPFLGPQSEPSALPGLDLFLNSHKLQGAAAVSLARHWPITSNRLGRAPVESPVPSHFRRVALLPRSRSQWPDKQSHSGVVRPGRVSPVGGRGALARRVSGEAKCKALVRGASGSHGGAAGQGPAVTRSPSSLCLALCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782592 - protein, 776 aa, Homo sapiens
MRPRTRGKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782593 - protein, 617 aa, Homo sapiens
SSVPVQVVLVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782594 - protein, 370 aa, Homo sapiens
SSWYRRSLCGVPRLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782595 - protein, 262 aa, Homo sapiens [sequence omitted]

SEQ ID NO: 782596 - protein, 171 aa, Homo sapiens
TGASPILHLYAGSAPLGSLPAANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782597 - protein, 157 aa, Homo sapiens
MGQPGKPGLLLLPLSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782598 - protein, 250 aa, Homo sapiens
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQVL

SEQ ID NO: 782599 - protein, 1606 aa, Homo sapiens; identical to SEQ ID NO: 782591

SEQ ID NO: 782600 - protein, 1077 aa, Homo sapiens [sequence omitted]

SEQ ID NO: 782601 - protein, 1696 aa, Homo sapiens
MKSKGFPFKLGIAAEPQAVSDISTKPLREAGCARVRALPGTAHLLGLDMHGLGRWDAVGVEQHPWLPPTKARSTPFICDHKNVSGLCKHPLGAVSPTENSYYRGRCVILRFLLEKLRSLVDEAEMCPLSEWPCPVLRGPVPESGGDQRGWAEAEVSTGHDFWKSRLPWSLKGQYKSAVERAGYPLDSSSLGEILSIRVPHGAPSERPREPTQRLPGTGTGATWVPLRPCTFPHLKEGRGPRASSAIAGDQVSYDENVWGSFSPAGSVSLLGKTIGKNVCFAFRISHIECALPSELPEVDGWLRFLVIRAAPTLQNVLVASLSVSRDCGFFALAHVQGGALVQSSHRVSTFWSLPGPDLSPGRNVGQARVGPASELFSTVMVTGQRWRHSQPFLGPQSEPSALPGLDLFLNSHKLQGAAAVSLARHWPITSNRLGRAPVESPVPSHFRRVALLPRSRSQWPDKQSHSGVVRPGRVSPVGGRGALARRVSGEAKCKALVRGASGSHGGAAGQGPAVTRSPSSLCLALCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEASAPRGPRGGEEAPAGQQLSRIFHTEVHEALRGAHLPCTTYDSGCEQAQSRRWLGGLRGLQVALELWQVWGSPLPLLSPALLMGSHDSKKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782602 - protein, 1613 aa, Homo sapiens
MKSKGFPFKLGIAAEPQAVSDISTKPLREAGCARVRALPGTAHLLGLDMHGLGRWDAVGVEQHPWLPPTKARSTPFICDHKNVSGLCKHPLGAVSPTENSYYRGRCVILRFLLEKLRSLVDEAEMCPLSEWPCPVLRGPVPESGGDQRGWAEAEVSTGHDFWKSRLPWSLKGQYKSAVERAGYPLDSSSLGEILSIRVPHGAPSERPREPTQRLPGTGTGATWVPLRPCTFPHLKEGRGPRASSAIAGDQVSYDENVWGSFSPAGSVSLLGKTIGKNVCFAFRISHIECALPSELPEVDGWLRFLVIRAAPTLQNVLVASLSVSRDVVSLRLLMFRGELWSSQATGSAPSGHSLALTEPGEERGAGAGGPSLELFSTVMVTGQRWRHSQPFLGPQSEPSALPGLDLFLNSHKLQGAAAVSLARHWPITSNRLGRAPVESPVPSHFRRVALLPRSRSQWPDKQSHSGVVRPGRVSPVGGRGALARRVSGEAKCKALVRGASGSHGGAAGQGPAVTRSPSSLCLALCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEETSAPSVFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782603 - protein, 1337 aa, Homo sapiens
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEETSAPSVFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782604 - protein, 1606 aa, Homo sapiens; identical to SEQ ID NO: 782591

SEQ ID NO: 782605 - protein, 928 aa, Homo sapiens
FPGMGRPPRGVLRFSGMGKEVGNLLLENSQLLETKNALNVVKNDLIAKVDQLSGEQEVLRGELEAAKQAKVKLENRIKELEEELKRVKSEAIIARREPKEEAEDDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782606 - protein, 250 aa, Homo sapiens; identical to SEQ ID NO: 782598

SEQ ID NO: 782607 - protein, 250 aa, Homo sapiens; identical to SEQ ID NO: 782598

SEQ ID NO: 782608 - protein, 262 aa, Homo sapiens [sequence omitted]

SEQ ID NO: 782609 - protein, 147 aa, Homo sapiens
PYYYDSPRLARQPRLALTAPTSPDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 782610 - protein, 250 aa, Homo sapiens; identical to SEQ ID NO: 782598

SEQ ID NO: 782611 - protein, 106 aa, Homo sapiens
MEPPPADSKPAEGRRHPGLLSLPSWASLAYSYLPGPLHSCLGGPYEGSPAPAPTPNQRSTDLGELPHKPRWPPRAAAAALPASPHHPATSTVMYVRSLVCSPRISK

SEQ ID NO: 782612 - protein, 103 aa, Homo sapiens [sequence omitted]

SEQ ID NO: 782613 - protein, 56 aa, Homo sapiens
HTLVDALSHREVTGVLTTCTLLIRPHASENNKAQNMDYSESILFRILFGHAKVDPD

SEQ ID NO: 782614 - protein, 259 aa, Homo sapiens
PQNCLIFQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELL

SEQ ID NO: 782615 - protein, 148 aa, Homo sapiens
SGSRAPPLRPTRPVLYFGLNEVVRWWLLGGGCSLKMLCKWHAFYKQQWFFCPTCHHWQGTALYVSPFNKSYVSLAGSMSLLQPLEHSVIPTEVNRDSAQQQIRLMFEDWSLWYQWAFSAFSIQLLDSTGTRNSSVVEGRGGFGGSMQR

SEQ ID NO: 782616 - protein, 56 aa, Homo sapiens
HTSTHKHASRHTDSILENMNLIARLFSVYLGNIFAICKSGKVLQELADFLWFNLSL

SEQ ID NO: 782617 - protein, 64 aa, Homo sapiens
EPAPAANSLGLGLKPGQSMMGSRDTRMGTGPFSSSGHTAEKASFGATGGPPAHLLTPSPLSGPG

SEQ ID NO: 782618 - protein, 83 aa, Homo sapiens
QESSSVQSTPFKSKQAKKQVASFSSDHSLQQLSATSKTAAFASDLPAITHENVKFSTTIQSNTSYSKSQRSRNSVQNRAEPQT

SEQ ID NO: 782619 - protein, 122 aa, Homo sapiens
SSGPWSAVQVLPPLLGMWPQAGPDQLPVSPPCPCRGPFCRQGLQLNRRQNPRELAKKASTQELFVIASINSPGKQVFASFGESGGEEKSEQGSSLSNRNVLVCAFRCPVHTLPDVSLDPPSP

SEQ ID NO: 782620 - protein, 122 aa, Homo sapiens
MPSRHTNGMAAFPMGRPPYRCPKDQADGIHCLSFSLHWTHPQGYPVLTSEATSHYAANLTALLPAAMPQSQHYLNTTTGSTCMQLVSELRAQNHPSFPTFLSHLHALQHGMAVLAALRLQTG

SEQ ID NO: 782621 - protein, 122 aa, Homo sapiens; identical to SEQ ID NO: 782620

SEQ ID NO: 782622 - protein, 33 aa, Homo sapiens
MTPGFQLVRARPERSPASSQPSPCRPSPIFPPN

SEQ ID NO: 782623 - protein, 71 aa, Homo sapiens
MRAHRSCLEIRLGLQPCSQFWRPVQIELPSPGPNSPGGVLLPTRALCVWQAVWSEECASHALGSNYALGLS

SEQ ID NO: 782624 - protein, 49 aa, Homo sapiens
NKSNEVLWLMTGFSHPSSAVRVFPWNEKVTSQHDPLLSTAWVWLISVSR

SEQ ID NO: 782625 - protein, 108 aa, Homo sapiens
WVRDDTYQHRAAAAVTLQEDSVGLADLVPPVASAHGDDGELGQDDGPTDGGGHLLGALNTQTDVAIQRLLRRCAMADGVLAGLEKGLSHVSFCRHQVVPLVSNPQPAV

SEQ ID NO: 782626 - protein, 206 aa, Homo sapiens
ARKMTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 782627 - protein, 61 aa, Homo sapiens
APITVPGSHHHLWDPPEVHSPAICGLSEQLFPGAQKALSRGHCSILQSATRLSLHYISGIQ

SEQ ID NO: 782628 - protein, 89 aa, Homo sapiens
PLPSVLSWAPPGKELPSSLCLLRELAVASPQALLTPAIPAPEPPLHHEPARPPACHCQAPGACPAASGVHQRPEAPCRVEEHTLGGGVP

SEQ ID NO: 782629 - protein, 73 aa, Homo sapiens
PAHGSGMNSSFTGSGMNMATAPLMAEMLKCEENVHLRNYDMQYIDITSTGLASRSAGITGMNMAHLYKNWTTY

SEQ ID NO: 782630 - protein, 36 aa, Homo sapiens
MTKAKSSGESFLETLTAVVMVDLMGNFANLILCQMS

SEQ ID NO: 782631 - protein, 32 aa, Homo sapiens
MPGPELPWRHPGAGPRTHGPYELRNLPWAQGS

SEQ ID NO: 782632 - protein, 81 aa, Homo sapiens
GLCQVSPILMHGPVVRSPGLPGFSAAPSPQSPNPSGPPGDWTVSLWSWGCSWWCFQQGSFGCLAPGRGLWRQGVTYRESLK

SEQ ID NO: 782633 - protein, 116 aa, Homo sapiens
LGSQAYLGKGRKGPLQADPLPSCHLRPSVILSHARCPAEAGKPQGPLSLKGRAGSTLGACSHLVWERKFRSSRLWLTLTHGRGFPVCHIASEEGGLHLSHGTLRVSIRTLGGLRAS

SEQ ID NO: 782634 - protein, 52 aa, Homo sapiens
AAAYYYYCSNSSFYDVRESCHLDPADWKFSILSFNCCTPASLGNRVRPCLKK

SEQ ID NO: 782635 - protein, 129 aa, Homo sapiens
GGFSAQADQEWSPPVCAVTGLGTDKGELVREAGPSHRCCLCLAALSRASEQTLTNTLLRVSRSGSWSPAELPIHGKKHRAALLAPRRELGCISKSSMCEARGLGKGVFGEESAVVGGSEVEGKEGHAVG

SEQ ID NO: 782636 - protein, 172 aa, Homo sapiens
GGKDFCHQHGLFEHQKTHNGERPYEFSECGELFRYNSNLIKYQQNHAGERPYEGTEYGKTFIRKSNLVQHQKIHSEGFLSKRSDPIEHQEILSRPTPYECTQCGKAFLTQAHLVGHQKTHTGEQPYECNKCGKFFMYNSKLIRHQKVHTGERRYECSECGKLFMDSFTLGRH

SEQ ID NO: 782637 - protein, 110 aa, Homo sapiens
LWAGGRESMGKEEGGGGQGAEEGESEAEAQKRLPWKGEGTWASRLPVAGPVGRAGVQGTQQLLGSEWGRRDWARGEDQLSSVNWMPFPGNGSRHTPQPTAGRERSASSQP

SEQ ID NO: 782638 - protein, 988 aa, Homo sapiens
RCPVHAARAPQSHPQDPRPRQGLACAPRARPRTTSPAMPRRRPPASGAAQFPERIATRSPDPIPLCTFQRQPRAAPVQPPCRLFFVTFAGCGHRWRSESKPGWISRSRSGIALRAARPPGSSPPRPAAPRPPPPGGVVAEAPGDVVIPRPRVQPMRVARGGPWTPNPAFREAESWSQIGNQRVSEQLLETSLGNEVSDTEPLSPASAGLRRNPALPPGPFAQNFSWGNQENLPPALGKIANGGGTGAGKAECGYETESHLLEPHEIPLNVNTHKFSDCEFPYEFCTVCFSPFKLLGMSGVEGVWNQHSRSASMHTFLNHSATGIREAGCRKDMPVSEMAEDGSEEIMFIWCEDCSQYHDSECPELGPVVMVKDSFVLSRARSWPASGHVHTQAGQGMRGYEDRDRADPQQLPEAVPAGLVRRLSGQQLPCRSTLTWGRLCHLVAQGRSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVH

SEQ ID NO: 782639 - protein, 679 aa, Homo sapiens
RCPVHAARAPQSHPQDPRPRQGLACAPRARPRTTSPAMPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVH

SEQ ID NO: 782640 - protein, 315 aa, Homo sapiens
WKLGVTPGRIPSFLAYRLGISWEVLEGGRFHAACNLELFSHLSFPNLLTSLGRFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKDIALMDDHQREEFIGKIGISSEENDDNSDESADSEPHKYSCKRCQLTLRRGLL

SEQ ID NO: 782641 - protein, 290 aa, Homo sapiens
IEAQIDLQAFWWPELEQSRFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVH

SEQ ID NO: 782642 - protein, 304 aa, Homo sapiens
WKLGVTPGRIPSFLAYRLGISWEVLEGGRFHAACNLELFSHLSFPNLLTSLGRFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVH

SEQ ID NO: 782643 - protein, 605 aa, Homo sapiens
MAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTGLIAHPGEGGPGGSRLRDLPDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVH

SEQ ID NO: 782644 - protein, 187 aa, Homo sapiens
MWTLRWAISLTACPSDQVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKDIALMDDHQREEFIGKIGISSEENDDNSDESADSEPHKYSCKRCQLTLRRGLL

SEQ ID NO: 782645 - protein, 85 aa, Homo sapiens
PPTSASKSAGIIGQMGILDVTTDIQISTCKNMSHSRFPSFVHAFNKYSMSGDFRILGYNGEQDNDELDAGCFCSNKQRDEQDNFR

SEQ ID NO: 782646 - protein, 40 aa, Homo sapiens
SKRRRRKHNSDVQETPSEQDSSKGYRKAPEGPRALLICGL

SEQ ID NO: 782647 - protein, 127 aa, Homo sapiens
SQGGRSWGFEFLGLRNEGLRRGLLGLKEEGAGGNGSDEEPYGHPLSTGYPELSGRWGRVFTVRLGPRPAVGLCGYAALRDALVLQADAVSGRGSMAVFERFTRGNSEAPALDLPARTLQAGRVNGRG

SEQ ID NO: 782648 - protein, 94 aa, Homo sapiens
MFWRSLQGLGEEAFPTTSLSSWEAGTRSEATFPQDQAPHPQHHPFPRGCAPSLVLSTHTHPCPCPCSHLFCVHSHTPVSTPTPVSRVHSLTPVL

SEQ ID NO: 782649 - protein, 93 aa, Homo sapiens
TSAPATSCSSYNSSSYNSSSYNSSSYNSSSYNSSSYNSSSYNSSSYNSYDLSWRMFHVLMNRMYILQLLGRMFCKCLLSPFVLGYSLSSLFLC

SEQ ID NO: 782650 - protein, 115 aa, Homo sapiens
GAGLKETRQVLGTGSRQARSILCTDGPSRAAAPQITPAGLPEARAGKYQVLSQGLLQPRLVQPCLEQSELLLLHPHKPIQPQPCLKTTLSTNPSHGPRWWLHSLWPLAKCSQLHW

SEQ ID NO: 782651 - protein, 114 aa, Homo sapiens
QYSGKAVTEYCSPDSRHHTSWIKVKNLIIISSWVWCRGAMVALRSGSSKWLCPGRRVFAYLFMQQVFIKQHRGVERAPHWVGRDLDSSSAICKLGDFICKIEDGDSSSRFALWT

SEQ ID NO: 782652 - protein, 145 aa, Homo sapiens
MRKSGNVTLGRPLTDCGRTGLREACQRNDWHSLRTLYQAGPWKWVELAMAWLWVSGPWFPQNPEAAFTSRSSQIALGIAVTRHIPSMVFSFSESVSQGNDCKSQGSHIRGCERGRRLRPRRSVQLRAPSVCALHPSFPLVCLPDP

SEQ ID NO: 782653 - protein, 140 aa, Homo sapiens
RACLLGCRGGGFQPLLSRVRSVAHKLPAQGPQISCLHSDLQVSAPAYCKLGAFLLQNPCPLARKPWNFPRSLRQLQATGRSQMVRKGMNLKEEEPALPTLSGAPPKGTGKLHKQDLEHPGSVWAAEARCANVGTEVACLS

SEQ ID NO: 782654 - protein, 44 aa, Homo sapiens
TVATTANWLLALPKEAVSVPSPSLLAYLWKKNSLYSTVLNAIPP

SEQ ID NO: 782655 - protein, 78 aa, Homo sapiens
VSCCLFDDLKWSPQAACHHLNTKTCCTREGVVQEQEERHRHRSIGGKGHVTTEAEMKCCSHKPRNSKIAGHHQKLEEA

SEQ ID NO: 782656 - protein, 34 aa, Homo sapiens
MVTTHWILLWHWCLCLPSGNLLADLLGPALPFMA

SEQ ID NO: 782657 - protein, 67 aa, Homo sapiens
LWPLQPPYFKWGGLLGVQNVTCRYELHPPWVPLTCGNCGLRYNSGSNLSTKYMPWAYQVPQWLLRLK

SEQ ID NO: 782658 - protein, 85 aa, Homo sapiens
PCSGTSSSVPVASALTSGSDSPCLDTAMFPAAWTLACCPDPGLSPHSLHSAHQTLESCQSPAAGAYLNHIQLLNPPGGSPGVYTP

SEQ ID NO: 782659 - protein, 98 aa, Homo sapiens
TGRRKENEDMRIKLCSVVTLPTRTHELTWQKSNPHPRNTGCEPCDGTLSHSLSCTKVDTGFLDLIFYVDETLVANYTFKSREIHHLHFTIYVIVLVYS

SEQ ID NO: 782660 - protein, 83 aa, Homo sapiens
RVSLCCPGWSAVAIHRRDPTTDQHGSFDLLRFRPGPVHPSLGNLVVPRSREVTILMPNSVRTPDRHSALQPRTPELKGSSSLS

SEQ ID NO: 782661 - protein, 44 aa, Homo sapiens
MGLAATQRLGTQQESSTAPIPIPSSPNYLSHGPHFVDKIKLATF

SEQ ID NO: 782662 - protein, 47 aa, Homo sapiens
MQCPRHLSAGTQLFWSQKALQVLPVNCHPSDARLPATDSAIEYLHTA

SEQ ID NO: 782663 - protein, 128 aa, Homo sapiens
HTPNTVTFTNHIQHTHAFSNTHTVTFTRSHTTHTCILKHTYTVTCTHTQNIHMHSHTLTHSHMHSQHTHPFSHTHPQSHVHNHIQHTHAFSYTLTQSHAITYNTHMHSHTLSHTHSRMHSYAITYTLT

SEQ ID NO: 782664 - protein, 71 aa, Homo sapiens
MVYPLGPLCPLLSRSHWGSWVSSLSDFEAPRLCVLSYLSLFEQIFFFFYLNWVWKLLQKLDWVQDQIRSDN

SEQ ID NO: 782665 - protein, 155 aa, Homo sapiens
DRWRVPFYCLCVLNTALIGLLQSTAHPMAIVPAECIPKMIHCMKFMEDNVELHFVTPVFQPEGAGACYGRKVCLCFGEKVVHHDLPLLFDLSRDPSETHILTPASEPVFYQVMERVQQVMREHQRTLSPVPLQLDRLGNIWRPWLQPCCGPFPLC

SEQ ID NO: 782666 - protein, 91 aa, Homo sapiens
QGNALKPYSRGAGWLCSLHPHLLSAGLGGRVAFRKPASTSPNRRNLDDLSLVLDNLSPTSLKWLGRGMSGGVQRDTATSRPKCKFIFMRAG

SEQ ID NO: 782667 - protein, 78 aa, Homo sapiens
QGNALKPYSRGAGWRWTPRPVLPTSTSPECRPRRQSCVQKTSKHIPQPEIRGNEETWTISALCLTTYPPPPLSGWGGG

SEQ ID NO: 782668 - protein, 106 aa, Homo sapiens
RTTEDPERQPVLTGLFLSMCLVTVLGNLLIILAISPDSHLHIPMYFFLSNLSLPDIGFTSTTVPKMIVDIQSHSRVISYAGCLTQMSLFAIFGGMEERHAPECDGL

SEQ ID NO: 782669 - protein, 103 aa, Homo sapiens
MFRNSGKGRVWVLPWGHLGPGGRWPAFCLLSTSFLQKAPTSCVNRAGAHGPPQAPSPPHPRSLIADYTQSSLIPGQLPSLPQPPLALRDGLGASLGSQESRPG

SEQ ID NO: 782670 - protein, 92 aa, Homo sapiens
SPHRLFVTSHTSTSSSGHFSLHSSSSQHLILPHGLRRSRSPLTVPVVIEATQSDSTHSATQSFTPVTVVAFYNVPWSMILPLPIASFTLLPA

SEQ ID NO: 782671 - protein, 122 aa, Homo sapiens
PRGDWGHRVTLPRHGDLSWVTIHLSADSKFQGSNRRSVPASVHRTESVTRGGRDPGAAQGGEAAHIRAGSIRCPPRARGQREMVRSLQPGGQGHLAGTRINVGHRGDGEGEREGYPQPLFPL

SEQ ID NO: 782672 - protein, 70 aa, Homo sapiens
IVKEVKKLEQDPGLLQESSRLRSLLEELRTIVNDGPQLLGSSDSPTSASPVAGTIDGMSHCAQPCHLFFL

SEQ ID NO: 782673 - protein, 107 aa, Homo sapiens
GQCPTAGMPAVLRSERTVPGTSRQEVFYAYVTLYVAFPSKFCFISGVCVLVENFGFSRISEVNLNRFFPVSWLVYLDGWSCCVLRWARPQAQDQGFGVRQVMCEVPA

SEQ ID NO: 782674 - protein, 91 aa, Homo sapiens
GETGRRGRGHTQIFRPEPTEGGTGREATALHPYSLPAQTPGAARCSQQSPKVQSPEAADLIERSEWKSFRDQDVTPNPLPQVFYQCQPNQS

SEQ ID NO: 782675 - protein, 76 aa, Homo sapiens
LGLVVWGNTDLPSDSLCGFRGSPCFPELPWFPADETEKSPTIRVIVGWGRWHTPVAPVTWEAEAGESLELGRWRLW

SEQ ID NO: 782676 - protein, 81 aa, Homo sapiens
VSGTNSTETLASRPVRKVFPGLRSRRWRPAVPPEAPGRLCFLPFAAHIPGLGPILPPAAEPVPIILSASTHGHGCFLDSAL

SEQ ID NO: 782677 - protein, 106 aa, Homo sapiens
TSEPGAQGELSSALQPQVRIRTFTAAPTGAPQLGASRGLGCWSGWRRVGGVEELGCKPHAGSSGQSALKPSLVKEGKMAPGPQAGKEVSKEEGWRVRRGWQRVRRG

SEQ ID NO: 782678 - protein, 278 aa, Homo sapiens
TSEPGAQGELSSALQPQVRIRTFTAAPTGAPQLGASRGLGCWSGWRRVGGVEELGCKPHAGSSGQSALKPSLVKEGKMAPGPQAGKEVSKEEGWRVRRGWQRVRRGLCCRLRHDLFCTQAGERDFHPDALASSPRLGSPSANFTLGPVSRSYGGQYQVLPSASQTLLRVRRPPGPPGHPDHTDSISDTVSLSAQPGPTVASGENIDLLLSVNGGIWNTFISVTKEGGQIQVPQLTFDHPLFRSSLTIPGRNFPHEFLLTLSPRGNLSGANHSRQLQTT

SEQ ID NO: 782679 - protein, 36 aa, Homo sapiens
MHFRSLRTKLLLMSRNEEATKHLETSKQLAAANRGL

SEQ ID NO: 782680 - protein, 76 aa, Homo sapiens
GQTGERERDESQRGYSWKPMRIWCDKSVARDLNYKAYKLLVSEPTRSQHTQGKSFSFSASISKVLSILQQKLNLPT

SEQ ID NO: 782681 - protein, 103 aa, Homo sapiens
LGDLWIRGVRGVCSNELGDLWIRGVRGVCSNELGYLWIRGVRGVCSNELGYLRIPGVRGVCSNELGFPTGMWGKCTWSVCLNCNKTSLISIFIDDFKPFSCYS

SEQ ID NO: 782682 - protein, 69 aa, Homo sapiens
KAKSGKGTASSEKATTLNPTDAFSHQPQNHPQGLWLTPAHEQMGSTPPTHTLPRRLSAFSRPHSQEPPF

SEQ ID NO: 782683 - protein, 34 aa, Homo sapiens
ETLLPEEQVDAGGAHEVYDFSAEAPLIGDPSSSH

SEQ ID NO: 782684 - protein, 140 aa, Homo sapiens
MKHMNAIHSPIHPSISASICPPNHPLFIHPTTHPSTQSPNHPSIHPSTLPTSIHLSIHPPNHPTTHSSVHLSNHSFIDAFIHPFIQPVTQPPIHHPSIHPSIQLPIHSSIQPTTQPPILQPSTYIYQSTHLPISIHLPYH

SEQ ID NO: 782685 - protein, 46 aa, Homo sapiens
ASLPCYSINLCLLHTHIKSTHSRPGTVAHTCNPSALGGRGGWITGG

SEQ ID NO: 782686 - protein, 100 aa, Homo sapiens
DVIWWLADCGIDVQGLDTALFREHASQMGMNQDSGDECVCVSVGVPGCAQGTAGAKVMLGSQGDHHWSLQHCWVWVTWQKCGARWGLLTKRGLMVPLWLI

SEQ ID NO: 782687 - protein, 36 aa, Homo sapiens
GHWSEVLEPATMNTKFKWPWICPSRGSKMKHVFTNC

SEQ ID NO: 782688 - protein, 51 aa, Homo sapiens
SSTQEDTPRASSTQEDTPRASSTQWNTPRASSPSRSTQLDNPRTSSTQQDN

SEQ ID NO: 782689 - protein, 54 aa, Homo sapiens
LWGPGTARMPRGTAGENGSEEETGAVKVGMPVRQILHSLKANRLTNGTTYGAAS

SEQ ID NO: 782690 - protein, 120 aa, Homo sapiens
MLDCSCEPTRPAVHVFYSMYSFFHVFIHRVLLSAYPVPDTVLGTCEQQGTEQASAFMELKFWGCRECIGDGFLTNKYGVSQIVINSTERNKAGCRDSKCVVVSVGSCSPWCTGGQGWLHG

SEQ ID NO: 782691 - protein, 82 aa, Homo sapiens
GKRALFTHWHKARGVSAEEVGGTLHLLQVEGPWLGHRLQCLLQLAGLKDLLGLRAEPLDQEPGQVLQDGLAVQADKLLPAHL

SEQ ID NO: 782692 - protein, 57 aa, Homo sapiens
MQKTKGETVCEMNLRNQEFQFGHDQFEMIRHQMETFIYTFMQDARTYNIKNDDVTDA

SEQ ID NO: 782693 - protein, 107 aa, Homo sapiens
NTLGNFFFGNTGFMKTHTYTHTNFELYLMKCLPKYAKGQWMDVSYLLWMQLTLKCNKCWDYRHEPLHPAPSGFSTRANKVIPWENNHLINNARTIRKRRKFNLSVYV

SEQ ID NO: 782694 - protein, 141 aa, Homo sapiens
MNQEPKCKSINSKTLRGRHGGNLHDIGLGNNSLDISPEAQATKEKINKLDFIKIKNFCLSKVTTMPNPRIYISNKFPGNAYAAGLETTLEETTPSENSSCLPRGEGMRKRILKKASKLWPTLIEDHRHLKLSAEEDAVVMP

SEQ ID NO: 782695 - protein, 119 aa, Homo sapiens
YRYRLIQKMDPPSLQELRSRWQPVLTGLCLSMCLVTVLGNLLIILAVSPDSHLHIPMYFFLSNLSLPDIGFTSTTVPKMIVDIQSHSRVISYAGCLTQMSLFAIFGGMEERHAPECDSL

SEQ ID NO: 782696 - protein, 119 aa, Homo sapiens; identical to SEQ ID NO: 782695

SEQ ID NO: 782697 - protein, 125 aa, Homo sapiens
GTLGLAGLMLWAAAAVTAELDVSWGNGECRAQGEQVCLERWSVSSRERRKPHRRPAEKETLQGTARAGDVKCCCCLRGWRASSAEVFFWKGMGRWLDSTLACEYHAEPLFLVSVEGPRSSWTQLM

SEQ ID NO: 782698 - protein, 72 aa, Homo sapiens
MLENSPENPENLLTKLEDSPENPENLLTMLEDSPENPENLLTKLEDSPENPENLLTMLEDSPENPENLLTKL

SEQ ID NO: 782699 - protein, 54 aa, Homo sapiens
STATPLLLAKPCRGGNQLTASTNCLSQAGVIMGLGRRGLGCRACCPAGYGKDVP

SEQ ID NO: 782700 - protein, 142 aa, Homo sapiens
WRKRGHESDLGGLSLGWGGEAQGSECGLGATGPTHILVPLLPGWVTVSKSAHLPVHQFPPCKMGVAPQTSWGCGESKPDNTGTRSSMALPMPALLSSCSAHPPANCELFVEGGCLLGVCVPSTGLRASTQALLCAWGWETQK

SEQ ID NO: 782701 - protein, 92 aa, Homo sapiens
GPGARGGTHPASWMEWRTGLVNDSSQTCFVNSSAHSPTPWLPSLSCDIFLLSPPTQSCRHTWTLSINLNCNHLQITDLDTPPFDLPAVLLKK

SEQ ID NO: 782702 - protein, 206 aa, Homo sapiens
MWHFSTFRRNTPSKVGSYSEYYRVNWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRER

SEQ ID NO: 782703 - protein, 165 aa, Homo sapiens
MASVLRMMPGLPGTTEPPTGRLGVGLAQGRSSAIDTHSMWWAGLGGDTGTEKPEKLQPLRRVSATWGKMISWFQPLRRVSGTWGKMTAWSWQLLSLLSPGPCREAWKGGTGLDPEELSDAGLDCFRGHLAHSPPPGEDLLEPGKMKDPPSAVKPRIPPPCRWTAS

SEQ ID NO: 782704 - protein, 111 aa, Homo sapiens
MDEWAPVRPTRGGYRSYRESLSGISERGHQARLKAGGTGSPGPAPHPGGQVAAPAQLGGPRRNRPEDTVMEILRQQWEAGGVKEQWPLPTWIQELWQSNDRSFRSAPQGTA

SEQ ID NO: 782705 - protein, 43 aa, Homo sapiens
MRRLTLHKHATITHSTSPWHLTTRLNTSPPRTTANSLIDDSPT

SEQ ID NO: 782706 - protein, 46 aa, Homo sapiens [sequence omitted]

SEQ ID NO: 782707 - protein, 119 aa, Homo sapiens
FFPSLINSFLPLRFAYSFNKHLLAFSNIPGSVLGHRGKIKAPNAQKSLPWVSFTYLIISPFQNTFCSIRSLRCHLPLIGPFILPEPTHLTQDLPLDPPKTDNTVGASTFLRTALASCVP

SEQ ID NO: 782708 - protein, 198 aa, Homo sapiens
VAESRTRQLQGLPAGGCSLLYVCVRHGCVCVCVGGVRLCVCLCVCTRSACLCADFCLSLTSLSLSLSLSLCLPSRSFRGPLFLSLSVCVCVRLGTHVPCAPEGGFLARRPFFWSASPRVSAWVVWPVGSRRPGGSSLGVCEGLGNVGIGVGPAGVFIPSPSGAASLLGWIQTSAPQPRTTASQALIVHPQEGARRASR

SEQ ID NO: 782709 - protein, 184 aa, Homo sapiens
RPGFAEGPAAGRNPRRKKPQTDRRRGSAGSSLRRARTVCGFCLSLTSLSLSLSLSLCLPSRSFRGPLFLSLSVCVCVRLGTHVPCAPEGGFLARRPFFWSASPRVSAWVVWPVGSRRPGGSSLGVCEGLGNVGIGVGPAGVFIPSPSGAASLLGWIQTSAPQPRTTASQALIVHPQEGARRASR

SEQ ID NO: 782710 - protein, 122 aa, Homo sapiens
MPRCPKLACGPRPNYTPMACHCTMFMPGTAKSGWQEPRQRLLQLEGIISPHPSVIDRNWHTHCQTTLSLGGGRQRWTQPTGLAGTAGSRGARWPPTVKSGRGGTLPTGYPLDQSSSTQSPFP

SEQ ID NO: 782711 - protein, 49 aa, Homo sapiens
IHTQPKHIKSQLPKDQVSRKRMKPPPPVAKNLIIELSFFLLYKTAFALL

SEQ ID NO: 782712 - protein, 166 aa, Homo sapiens
NEIYYFINIKQRKPLEHTRKAKRSHRPLEGGGLPLQAPLDSQGTSSSTVRAYQTSKSRVTMSPGFSSQWNSSQPAWNTYSFPRASLHYQSHASYTYCTGHPASSSTVRAYQTSKSRVTMSPGFSSQWSSSQPAWNTYSFPRASLHYQSHASYTYCTGHPAVKEIQE

SEQ ID NO: 782713 - protein, 166 aa, Homo sapiens; identical to SEQ ID NO: 782712

SEQ ID NO: 782714 - protein, 129 aa, Homo sapiens
EEIGQSQPSNTVREEAADLLWAEHSVLDHTLAAQRPHSTSNRDWSCNFLWGLNPKSPCGPSRASGDGDHLLLGITSGVVTVSSAKEREVLIVRGGTGQISFRDQGSLAESLEVTCMKNGGIWPEGTRSP

SEQ ID NO: 782715 - protein, 120 aa, Homo sapiens [sequence omitted]

SEQ ID NO: 782716 - protein, 30 aa, Homo sapiens
MGRTVTEEEEVNEPEAGRVASGYGDDCKLS

SEQ ID NO: 782717 - protein, 127 aa, Homo sapiens
SALRALHHVWTREWGGSAREWVLPVSGSNSWFTVMILFVFPVFCLAWQQGRKRATGSLQFVLGCSCSHTRALKQAACTLDAFTWGPLVCKSKAWEVFPFHGPARCGWHFTYSCITNVIQIQVKGQVS

SEQ ID NO: 782718 - protein, 518 aa, Homo sapiens
MWDWAPTTSLQEVNKTVLVFALTQHTDQGGRPECALSVISTNNDVSSSVLRRTKSVSSMSEFESLLDCSPYLAGGDARGKKLPNNPAFGFVSSEPGDPEKDTKEKPGLSSRDCNHLGALACQDPPGRQMQRSYTAPDKTGIRVYYSPPVARRLGVPVVHDKEGKIIIEPGFLFTTAKPKESAEADGLAESSYGRWLCNFSRQRLDGGSAGSPSAAGPGFPAALHDFEMSGNMSDDMKEITNCVRQAMRSGSLERKVKSTSSQTVGLASVGTQTIRTVSVGLQTDPPRSSLHGKAWSPRSSSLVSVRSKQISSSLDKVHSRIERPCCSPKYGSPKLQRRSVSKLDSSKDRSLWNLHQGKQNGSAWARSTTTRDSPVLRNINDGLSSLFSVVEHSGSTESVWKLGMSETRAKPEPPKYGIVQEFFRNVCGRAPSPTSSAGEEGTKKPEPLSPASYHQPEGVARILNKKAAKLGSSEEVRLTMLPQVGKDGVLRDGDGAVVLPNEVGGWDLSFLLVGGVSI

SEQ ID NO: 782719 - protein, 518 aa, Homo sapiens; identical to SEQ ID NO: 782718

SEQ ID NO: 782720 - protein, 84 aa, Homo sapiens
SPLPLSTCCYKQVRGPPMSASATVPRVPCSRGPHHLCSSSDPGARQVEEHQQGRLMFQTLLPPVHLFIYAGKVTASTHLAQQGG

SEQ ID NO: 782721 - protein, 32 aa, Homo sapiens
MSVFRAHSLPLFLVVIGRKEDISWTPLQRLEN

SEQ ID NO: 782722 - protein, 194 aa, Homo sapiens
PARPSSSGFPAPPNQRCPAPPLLSREHPPSQPEPGAGAVAPGREVLGFPLARVALGGHPRPGSGGSSPSRFLGASAHPPWPRTRAPPGPGRLLQSAAAPWGDGPGARARTWKPTKWAVPNEVGTGERGAVQKPTPPPAPRGRGNPGQPVARIIPDYTRRPRQTKNTSLNSLPHRSLQAFVHTRYTDCGRIVIHS

SEQ ID NO: 782723 - protein, 55 aa, Homo sapiens
SPFEVTEETSAPPLFEEQHEPPRVSGGMRAACTRKGVQEDPKMCPSDPQPLHTLN

SEQ ID NO: 782724 - protein, 116 aa, Homo sapiens
DTCPSCPARLFKTAEECQNTEMQSPGTFGSTLPAHSQVKMQIFVKTLTGKTITLEVEPSDTIENVKANIQDKEGILPDQQRLIFAGMQLEDGCTLSDYNIQKELTLYLVQRLRCGC

SEQ ID NO: 782725 - protein, 116 aa, Homo sapiens; identical to SEQ ID NO: 782724

SEQ ID NO: 782726 - protein, 33 aa, Homo sapiens
MIESFCSSHFGVTDSFEHLMSLVKNGCLSTQPT

SEQ ID NO: 782727 - protein, 72 aa, Homo sapiens
WPHQGARSKTAPSAPTSPALLDVARSRCDPCPAGGLTADWLLEADCLPVCPQETGQGWSAGGRVAVTSDEPL

SEQ ID NO: 782728 - protein, 107 aa, Homo sapiens
VPTLFISAHWGSQDTDPGFLTPGRHPNQDSDFLISEVVHFFSDLHGNSEPHRGVIPVSSFSEVPHPTPQQVSAALSPPPLLCSCFSWMAECFLRSVCCFTLAPWSGI

SEQ ID NO: 782729 - protein, 67 aa, Homo sapiens
RHPVVMVIPSLKALEAGPSDHLRSYLTVPLLSSHCRRAWSGCSIRSYDSSGAPMGLPPPTTLVPHLS

SEQ ID NO: 782730 - protein, 68 aa, Homo sapiens
PLGTTAPFTISSSYNSSSYNSSSYNSSSYNSSSYNSYKPKHKLTPKHFSLHSLLANVRMLCSIGYESK

SEQ ID NO: 782731 - protein, 35 aa, Homo sapiens
GVGGGEAEAGKGSSPSEREALLGRPGLAICERGAF

SEQ ID NO: 782732 - protein, 74 aa, Homo sapiens
MACIFHLCGLNAQASSCSRLKIQLVLLVSNAITLEPIPEAIEMGMEASMQEVRVLCKEHTYNNGPQTHFFPSVP

SEQ ID NO: 782733 - protein, 78 aa, Homo sapiens
PYTSPYLPPPLRGDTDLLIHPDFSGRSWVLYALGALNAWQLEWVSLEAFRLSFYNHRRAITGREILGAVKQRSSQKSF

SEQ ID NO: 782734 - protein, 77 aa, Homo sapiens
PRDGFIMRVLRVRGLAEIHPDFSGRSWVLYALGALNAWQLEWVSLEAFRLSFYNHRRAITGREILGAVKQRSSQKSF

SEQ ID NO: 782735 - protein, 71 aa, Homo sapiens
HINEPERKTLGIHPDFSGRSWVLYALGALNAWQLEWVSLEAFRLSFYNHRRAITGREILGAVKQRSSQKSF

SEQ ID NO: 782736 - protein, 74 aa, Homo sapiens
TCEESMIQVFESFAIHPDFSGRSWVLYALGALNAWQLEWVSLEAFRLSFYNHRRAITGREILGAVKQRSSQKSF

SEQ ID NO: 782737 - protein, 99 aa, Homo sapiens
LRTPPTSRQEGRCDHDRSTRRADGDTGAGGETGVYGVQQAGVDGMRHTNPGTEMEGREREEEREEQEREGERERGMQTGGKFEDTKRGPGNGLNRGGMG

SEQ ID NO: 782738 - protein, 91 aa, Homo sapiens
IRTHSGPARIMWKSGLSAGFLVLVRCLRQTSFDQTYSTTMKSTSIPVLQCGDFVSDTAVFVLPALSPLKMYFSLLEDPKEMTKKTSSLQNS

SEQ ID NO: 782739 - protein, 69 aa, Homo sapiens
PQDCLGIACLSLECQVTTLGWPSEPLTAPHTSQSGQSIRDLSDLSTVTQLVPKKSQGQNLRPVTQAPVQ

SEQ ID NO: 782740 - protein, 123 aa, Homo sapiens
MQWFDDGVGSVPCCGYIVALRLALWHMMSDPLRDLASDMQTYHRPVVGQRLDRDENTFMRDLAAVASVGLPLLGRQAQVAAGRVLVVALFGGFGGLHSRLDGAAICLPGHCHSSRVEVTDQTH

SEQ ID NO: 782741 - protein, 78 aa, Homo sapiens
ACAHIHSCTQDPCQCTCVLLPATRPHTADVSVHTCAPACPHLHSAVSVHACCCLPHIHTLLLMYRCTCAPACHTSTHC

SEQ ID NO: 782742 - protein, 85 aa, Homo sapiens
VRRRLQGPARLGPIHSSAGADQASPLCWKPSPKERVPWGPHPDSGPALRLQGGRWRCPGGPCPSLPSGCTTPRQKGSERDLGRES

SEQ ID NO: 782743 - protein, 58 aa, Homo sapiens
RPWGLSWVYSCPGGRDPKVGQGEGWARWLTPVIPALWEAEAGGSRGQEIETILANTVK

SEQ ID NO: 782744 - protein, 109 aa, Homo sapiens
GPKRERSCESRGVTSFSPGHVGWPIRISTNLSTSPFGLVYFVLFHPAFTLFCSSSLQDKREPTESHRVELENKILVTMEAYALEAKVCSLPEKTFITNGYSIFSSQALG

SEQ ID NO: 782745 - protein, 106 aa, Homo sapiens
MLLSRNTVLQGQPFGGVPTVLCLNIALWVLVLVVYSFLRKAAWDYGRLALLIHNDSLTSLIYGEQSEKTSPSETSLEMERRDKGFCSWFFNSIKMKDEDLINKCGD

SEQ ID NO: 782746 - protein, 127 aa, Homo sapiens
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSIKMKDEDLINKCGD

SEQ ID NO: 782747 - protein, 110 aa, Homo sapiens
MQLTAGLTPCPLYSGRKMRSHGPRPHPSTLESQIPHFHILKSLTLSFPFSLRKLKCSLTVFTRAAIPASALAFRLCQGQNIVLISRTPFWVDPSQVHPALSPRQPWLLSA

SEQ ID NO: 782748 - protein, 77 aa, Homo sapiens
MDAMPCPLRLKCGGDLRLAPVHALATSCLNSTLGGQLDQRPQQTSFTLAGGSTLSDQTQTSVYNWWGPCLGGCLLCV

SEQ ID NO: 782749 - protein, 44 aa, Homo sapiens
MTPTASRRERTGQLPHCRIPLSSAEPGPESGANSDRKEPNIGFL

SEQ ID NO: 782750 - protein, 50 aa, Homo sapiens
AAAYYYYYYCSEFKLLTMYGDMFLNPRSFLRGSGTSAPLLSPKIHFTPTA

SEQ ID NO: 782751 - protein, 89 aa, Homo sapiens
GPTHAQAAFGSQALVAVPRVWGPWGARMLLSSAPAWRPLSPPKLCKLSVVQAPQKPMRLTGRSASGAHPATPEPLAVDCQLAIHAWHCP

SEQ ID NO: 782752 - protein, 38 aa, Homo sapiens
ELGKPHKQLPTCKNSKSYSWEHLLRTLLENKRQATKVT

SEQ ID NO: 782753 - protein, 124 aa, Homo sapiens
SWPRHRQPARLVCEAFPAGRAHPAAPAPVPAPGIWGRFPLLFNRQRHLGPSFPVRWDGAPVRLCLISRNTGTPQKVLPPVVWSPTSRKKPMLSARNSMMFGHLSPVRIPRLRDSGAHVSPGDIV

SEQ ID NO: 782754 - protein, 115 aa, Homo sapiens
AAGASKDIGQTNRLPAKKQLVLPRSPWPSSRFWFPRRCRRWVFLLALLPALPCSSQFHVAAGWSHPEPYSLALFHLPCISESFRHCLVPRYCLFVGPWFPQTLMITSNISLPPPC

SEQ ID NO: 782755 - protein, 81 aa, Homo sapiens
KSAQEVPLNPSNWSNLKTPALPYSPFCDASRATRNLSPMASGRPEGAVPLTCQRGQMPSFPACPSPQETGSRAPGPTPQRE

SEQ ID NO: 782756 - protein, 149 aa, Homo sapiens
LQLLLEHQDCIAPDHQDPLHELLEDLGELPTIPDLIGESIAADGHTDLSKLEVSLTLTNKFEGLEADADDSNTRSLLLSTKQLLADIIQFHPGDTLKEILSLSASREQEAAHKQLMSRRQACTAQTPEPLRRHRSLTAHSLLPLAEKQR

SEQ ID NO: 782757 - protein, 113 aa, Homo sapiens
PHVNFSHLTTKDYMEMYNVIMTVKEDQFSALGLDPCLLEDELDKSVQGTGLAFIAFTEAMTHFPASPFWSVMFFLMLINLGLGSMIGTMAGITTPIIDTFKVPKEMFTGNSSL

SEQ ID NO: 782758 - protein, 41 aa, Homo sapiens
MALACQCPPKLDVTSCPYLTFGSIGHGLSDKGMLWKCGFWP

SEQ ID NO: 782759 - protein, 76 aa, Homo sapiens
TPRLELFWGVYFTLLPELSPKFKLQNHCGSLRVTFLVGSLPPSLITPIPPQNHPHKLLALNPRSKFCFWLSWCGSN

SEQ ID NO: 782760 - protein, 70 aa, Homo sapiens
STNHSTQSALNQSLHTVGAQQITAHSRRSTNPCTQSALNKSLHTVGAEAPLPAYFTPTPVRLRGDVRLSG

SEQ ID NO: 782761 - protein, 64 aa, Homo sapiens
YTHVPNSIIHNSQNMRATCVHQPVSITWIYKMWHIYMAEYYSALKSKEIMSMLQCCCNPTTLDE

SEQ ID NO: 782762 - protein, 137 aa, Homo sapiens
SLCLTHLQAIRAFLSPNLQTYSHLGILHSLLLLPGMLFLYIIPFVSAQSSPSEKVPLTTFLRKTPPLSVPPSYHPLSFVAQHCSQSVVILPFSVFYWDLSASPCWNECFTRPCSSLTLHRPGPQQKPACTTGFLDNY

SEQ ID NO: 782763 - protein, 68 aa, Homo sapiens
SIITRHQQGFSRRYWQAVEKGVRHGASSSRSLCLPSRDPNISQHKHPRELPCGSVGNGSLSRAARSWQ

SEQ ID NO: 782764 - protein, 142 aa, Homo sapiens
LLHSGEMPFSCECGKGFVKHSKLIEHIRTHTGEKPFQCPKCDKSFRLKAQLLSHQGLHTGERPFHCPECDKNFRERGHMLRHQRIHRPERPFACGDCGKGFIYKSKLAEHIRVHTKSCPAPNELDIKKRLSQLFAMIEADWS

SEQ ID NO: 782765 - protein, 48 aa, Homo sapiens
RSRGSQMQPSSVLAENTNRYLVLTPYLLSEILGEESGLLSSPSDSYVH

SEQ ID NO: 782766 - protein, 163 aa, Homo sapiens
MNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVYNKELEHALEKNEVDLPVHSLKDLPTCASSWLHHRSLCKEP

SEQ ID NO: 782767 - protein, 217 aa, Homo sapiens
MNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPI

SEQ ID NO: 782768 - protein, 116 aa, Homo sapiens [sequence omitted]

SEQ ID NO: 782769 - protein, 36 aa, Homo sapiens
MLTQLPSIRCCRRGDALSTRARSTCSFSAMRSAPGH

SEQ ID NO: 782770 - protein, 66 aa, Homo sapiens
SMYMSVSRSMYTSLGVHAQVHASVCMWLCVCAAACVLVHVGICMWLHVASWEQRCPGEEEPAVVWS

SEQ ID NO: 782771 - protein, 103 aa, Homo sapiens
PGRASAGAWHRPGPWPRCSVDCSFLVPGPLAAPGSCPGSSALGAPGSPSSVFHYDQSGYRQEGSGLPPPWATWTESWERLPQTTWVGGPQGPFSPWARSTACV

SEQ ID NO: 782772 - protein, 59 aa, Homo sapiens
NNNNNNNKNNTKNKETSGPGSQGPPVPLHIPFSPSPISIGPYPCAIFLQPPFNFGAIIL

SEQ ID NO: 782773 - protein, 56 aa, Homo sapiens
MPESEAFLLFQPQRGLPLLLILLSTDPLRVLGWGTVRSFPSHEAISQAVSVAGKPW

SEQ ID NO: 782774 - protein, 81 aa, Homo sapiens
RRHDVEKRPSAELIRTPDGALPTGLCVTQVSVPWHLLLGLSCAHPTCRSSRTPYYLSHCPDLPTPFYFLPGTDASVCLLSF

SEQ ID NO: 782775 - protein, 80 aa, Homo sapiens
SGCKQRCYHKDRKQRPHWCSAGLQALPGFIVGEATRPAPSQRDVTHAAGCHPQNSRETLGAPGQEEADVNFNSGDFKRNF

SEQ ID NO: 782776 - protein, 148 aa, Homo sapiens
RRVTLGVSLPVATNAFPNGMIRAAQQPYTRSLNPTSSRKPREVIWEHSTMWGWGRMHPQNGPGVSTAAHTGSGAHLTPLLSPKPLSSPLLDIDKHRGWAWRSPAVCLWMGQDTQEGHQCAESQRARGHTGTCRVALTTHPETKAHKNR

SEQ ID NO: 782777 - protein, 115 aa, Homo sapiens
LCVHACAFVCVCMCTQACAVQVPMCIFKCAHPCAWANVCTSTCVSELLCVCLCDVISPHPYGCRTKAVHTEHPAHALGSTPSFLTVPQCIQRDLNLIPSFASYSLHDLRLVMQAL

SEQ ID NO: 782778 - protein, 207 aa, Homo sapiens
YVLISSTDSNFQKIYRLNLNEGKMCYKKLEEVKTSALDNNTSRTYDPVHAAPTTSTRVFYISVGVCCAVIFLVAIILAVLHLHSMKRIELDDSISASRSSQGLSQPSTQTTQYPRADTPNNATPITSSSGYPTLRIEKNDLRSVTLLEAKGKVKDIAISRERITLIKDVLQEGTFGRIFHGILIDEKDPNKEKQALVETKIKLLKFR

SEQ ID NO: 782779 - protein, 69 aa, Homo sapiens
LQPKALGSWDERWTVGTACHPAGTSWPWYQCLRALAVLSRDLEAQTRALQSLSSSNTLQLYFPQQLLVH

SEQ ID NO: 782780 - protein, 107 aa, Homo sapiens
MGVSLCRPGWFQTPRFKPSSSLGLPKCWDYRHEPPCSASPVSLGQYLNTKANLELLDSLQVVNWVLVISRALESDFIGFESLSPFSQLSNLGRVAERVFASASSSVQ

SEQ ID NO: 782781 - protein, 94 aa, Homo sapiens
DQVSQGRVALYLSEKGGLGRPGPSAHLLTGRIGSWDSVGHSLLLPPDVHLTAAPKNPPRPSLAPSPPPSAPGQHSLAQVWAAFAVALPCDCEHL

SEQ ID NO: 782782 - protein, 44 aa, Homo sapiens
MSEEDRFSGLPARDGSCGFLLRQTKLPFWLMAGFTSQMYQVVSP

SEQ ID NO: 782783 - protein, 96 aa, Homo sapiens
GESESSVTAHGKFFNTLQAQGEKASLYVIRLEVQLQNAIQAGILAEKDANQTRLQQLLLGAELNRDLRFRLKHLLRMYANKQERLPNFLELIKMIR

SEQ ID NO: 782784 - protein, 80 aa, Homo sapiens
RIRKLFNLSKEDDVRQYVVRKPLKKVRNLGPKHPRFSVLLLHVFGKRMKEAKEKRQEQIVKRRRLSSLRASTSKSESSQK

SEQ ID NO: 782785 - protein, 68 aa, Homo sapiens
SALHPLSLLVQAIMLAMTLALGTLPAFLPCELQPHGLVNCNWLFLKSKEKPADASKESENKSEVNDKQ

SEQ ID NO: 782786 - protein, 50 aa, Homo sapiens
MYTFLVIHKSSKEYGVSTLFSRKEQNRPKRCLYTGGRWRVHGSPVGLAAS

SEQ ID NO: 782787 - protein, 110 aa, Homo sapiens
DSFQESAVGVRLCHSGPPPQEGLTASVFAPLGALSTTQVVQVERPHGEGQALRSPGGEARPDHHSIRAKPPMASSPGPSSQETPSKSSRRPTQLSPATPQSHARSHNGHF

SEQ ID NO: 782788 - protein, 282 aa, Homo sapiens
RSRRRRSGLPGPGGTAGTMAEPPRLPLTFEDVAIYFSEQEWQDLEAWQKELYKHVMRSNYETLVSLDDGLPKPELISWIEHGGEPFRKWRESQKSGNILCSSVDMHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRSWCLLRHLAAHTG

SEQ ID NO: 782789 - protein, 193 aa, Homo sapiens
MAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHEVSELQFH

SEQ ID NO: 782790 - protein, 109 aa, Homo sapiens
NRPWDSCFLRKKQRQANATLLPEELLGAHCTLITSQGFLMAQDAKSSTHRQGGFNLAKQESSVSYCTPLIPRPSIPCPELLDMSPCAHFIDGKTELQQREVTGAIPYSS

SEQ ID NO: 782791 - protein, 102 aa, Homo sapiens
PGSLAQTGLLLAPLLPSLHPLLGTPSQLLEMVSVLVGPQNCLSLQSMSLSLLEHPLPLFFTEPNYSDPSFKTALSHCTRKPSMTSPRYCHDLLPTSCNCLWV

SEQ ID NO: 782792 - protein, 346 aa, Homo sapiens
VFPAPGIIVITDGVTSVPDVAVCETLLNQLRSGTVACSFVQVGGVYSYDCSFGHVPNVELMKFIAMATFGSYLSTCPEPEPGNLGLTVYHRAFLLYSFLRSGEALNPEYYCGERHTEALSTAYLMSTWSLQAATLPWPCAGRSTLRRRCQPTWSALCPYGFERATVSERSHWPKEGPNLEVKLVLLWKHNMRIEYVAMASWPLEPEGPRVTRVEVTMEGGYDILHDVSCALRQPIRSLYRTHVIRRFWNTLQSINQTDQMLAHLQSFSSVPEHFTLPDSTKSGVPLFYIPPGSTTPVLSLQPSGSDSSHAQFAAYWKPVLSMDANSWQRWLHMHRLVLILEHDTWV

SEQ ID NO: 782793 - protein, 110 aa, Homo sapiens
LAECHVLTSLRSIQQTLKDGQRDRRWSFIMQCDLCCNRVLEARSSKRGVGSTMLSLKMLGRICSMPFHSLLGFPASPDIPWLVDTPPQFPPPSSHGLLSVGASAFPLFFF

SEQ ID NO: 782794 - protein, 102 aa, Homo sapiens
MYHHLSPSTGQAKALQSQAWIIFPGSPSMATPLQSSYSRLLLSCSCALPQAYPALGCPSLIQKSYYEVLVQLKCQSTHHIFFPAYSLQNYYIVFNVLVWFFC

SEQ ID NO: 782795 - protein, 117 aa, Homo sapiens
MRFLLEIFPSSFRTQDRLVWRCSLAKGISCYWFGSAWFCLGWGRCRWGRLGTSSGAMAGHCGISPSSGFGVPACLTWCLHTCTHTHTHTHTHTHTHTHTHTHTHTHTHTHTHTHTHT

SEQ ID NO: 782796 - protein, 82 aa, Homo sapiens
SENGPTLDAALTIIIIEQIGDACSKSQCQPSKDVFLLEDGLTGIIQCSLVSPVPLQLPRRTSSSPWNGAGPSFEVRLHTASL

SEQ ID NO: 782797 - protein, 73 aa, Homo sapiens
QELTTVPPLSQELTTVPALSHEHTSTGAKKSSHVVILETVQRVVGWDLRQESLVAGGRERMWGGSAEEQEQVL

SEQ ID NO: 782798 - protein, 57 aa, Homo sapiens
FYSEVILEKSPECRPSPKPESTSRVCKIKSNRKPETQQRLHRGKVKSFPKDDPSNAG

SEQ ID NO: 782799 - protein, 85 aa, Homo sapiens
MIKREYLLGGSISKKIATRATEIQDVNKIFIKQGICKLYKYGRLMTIRREWPSPLDAVAGTLLQMIWFKWQHLKIKCKHEAVGVE

SEQ ID NO: 782800 - protein, 106 aa, Homo sapiens
RLECNGTISPYCNVRLLASSNSPASASRVAGITGACHSWLIFVFLVETEFHHVGQAGLQLLTSSDPPASIFNSARITGVSSHAQPLVGSLCCGSFSPSHIGVLCAT

SEQ ID NO: 782801 - protein, 101 aa, Homo sapiens
VSIHQRHESWMGVRLVELERRGTQEGGLKTRLGKETMDNDRLGQDPRKWLQFSGKRRGSGKSSFSFASKEAEQLREKVAHSVKTQRNHTECGIIDAGDLEG

SEQ ID NO: 782802 - protein, 154 aa, Homo sapiens
PQHKGATVKDKTGIGPCELCLATLAVEATVDRVTHSLLGLFPPSVGWVYRAGAKPASEAPQPPPHHQVSQVGLLCCGTHTHTQVANSLEVSPSFQICQPKSHSGKYKWEPLQSGTLSGRYREPKNEVAESCCGDLSLLFLTEEDNEAQEHSFLE

SEQ ID NO: 782803 - protein, 119 aa, Homo sapiens
NTITTSTITTNHHHYLHQRYYHQLSSSFPPPPFSSLHHNHQQNHSYHYHYRKQNNHITPVLRRRKKNTHLQILISRNGCISHLMQRLLDILRMVQQVLRHVLCSTHSHYSSVGASSTGG

SEQ ID NO: 782804 - protein, 109 aa, Homo sapiens
DSQGSNDKSHLQGRPSGPRPLPLLRLVKSCSQALNDMLPSPCSQPIPAITIAEQMCGYHPLTLPHICQQQTTPVDHSPAQPTPGSTTNHPDLPPWPATSDQKSLLCLWH

SEQ ID NO: 782805 - protein, 364 aa, Homo sapiens
MCGSAARWEFGFGWLQPASRVKTPTPGAAGSTHGDPRGAAAAPGNWSSRQRPAHPRTPGPAASVFSRSVQRLTMRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMLDYMVHEEFNPDQANGSYASRRGPFDFDTKTVWQREAEELEKEKKKLRLPAIDSKYLSKAGTPLGPKNPAGSRLSFPHVPGQKNSSPTKFSKLISNGYKDEWLQQQQRADSDKRTPKTSRASVVSQSPRDLEGPQDAARLQDAEASEGPEDTPGPEESVSASTPAELK

SEQ ID NO: 782806 - protein, 296 aa, Homo sapiens
MCGSAARWEFGFGWLQPASRVKTPTPGAAGSTHGDPRGADWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMLDYMVHEEFNPDQANGSYASRRGPFDFDTKTVWQREAEELEKEKKKLRLPAIDSKYLSKAGTPLGPKNPAGSRLSFPHVNGYKDEWLQQQQRADSDKRTPKTSRASVVSQSPRDLEGPQDAARLQDAEASEGPEDTPGPEESVSASTPAELK

SEQ ID NO: 782807 - protein, 45 aa, Homo sapiens
MDARTHSTTQASFMHKIPVTNSPDKKDHEKYHLFLITVVQEIVIQ

SEQ ID NO: 782808 - protein, 68 aa, Homo sapiens
GRKSSRHRGSLLFTQQRKVHTGEAAGGTCRRPGWEIPGRRPGNARGSQEGSCAPWWPQVTHGTHEEVP

SEQ ID NO: 782809 - protein, 77 aa, Homo sapiens
HIHHHHYHHSTTTITTSTTTTTTTSTTTTSTSTTTITTITPLPRSPPLPPPSPPLPPPPPPSLPSFHYHQPRDRGVV

SEQ ID NO: 782810 - protein, 110 aa, Homo sapiens
SGVWGNLLMFPAGRVLCWNQHWVCPKRAGYPSQVLYLEFSDYSRCSPIPQKNPQMFLWSLHSPCLSPLPMSGQWSSSLVVLVLLTAQLMLEIKLAGWSMAPSLAWELIED

SEQ ID NO: 782811 - protein, 34 aa, Homo sapiens
MASHSSPARAHHASHGETVSVSLLSESGWPRDDS

SEQ ID NO: 782812 - protein, 114 aa, Homo sapiens
VIHFGRYVLQDSANKVSADQMYCPGIESTALYSTVVTKDNSSRVTDYFVVAGLTDTSTLLDQEINRLDTKSTGPKAPITDIAIIIKSAGETVPEGYTCVEATPSALQANLNYGS

SEQ ID NO: 782813 - protein, 39 aa, Homo sapiens
FLCWDLGLSAGPQPGARDSSEMLCLADLLISCLLPPGLP

SEQ ID NO: 782814 - protein, 131 aa, Homo sapiens
SRARSVPSSPSLLSAPAPGAAGATESSPAPKPKTTSPLTPVTAPKFPSSARPESLHSPNSMFRGPKPPIAPKPRLTAPNEWRASVYLNDSLNKCSNGRLPCVDRGLDEGPRSIPKCSESETDEDYIVVPRV

SEQ ID NO: 782815 - protein, 59 aa, Homo sapiens
MAPHEHTRHKNKQTSTNPTHAQATTTQQQTDEAHADKTQHNKNKRQQTNRQTAEQTSKN

SEQ ID NO: 782816 - protein, 1299 aa, Homo sapiens
MGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFRSNVLTGSAPQQDYDKLKALGGENSSKTGLSTSGNVEKNKAVKRETEASSINLSVYEPFKVRKAEDKLKESSDKVLENRVLDGKLSSEKNDTSLPSVAPSKTKSSSKLSSCIAAIAALSAKKAASDSCKEPVANSRESSPLPKEVNDSPRAADKSPESQNLIDGTKKPSLKQPDSPRSISSENSSKGSPSSPAGSTPAIPKVRIKTIKTSSGEIKRTVTRVLPEVDLDSGKKPSEQTASVMASVTSLLSSPASAAVLSSPPRAPLQSAVVTNAVSPAELTPKQVTIKPVATAFLPVSAVKTAGSQVINLKLANNTTVKATVISAASVQSASSAIIKAANAIQQQTVVVPASSLANAKLVPKTVHLANLNLLPQGAQATSELRQVLTKPQQQIKQAIINAAASQPPKKVSRVQVVSSLQSSVVEAFNKVLSSVNPVPVYIPNLSPPANAGITLPTRGYKCLECGDSFALEKSLTQHYDRRSVRIEVTCNHCTKNLVFYNKCSLLSHARGHKEKGVVMQCSHLILKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQKTCTICQMLLPNQCSYASHQRIHQHKSPYTCPECGAICRSVHFQTHVTKNCLHYTRRVGFRCVHCNVVYSDVAALKSHIQGSHCEVFYKCPICPMAFKSAPSTHSHAYTQHPGIKIGEPKIIYKCSMCDTVFTLQTLLYRHFDQHIENQKVSVFKCPDCSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKQMKKHPCRQCDKSFSSSHSLCRHNRIKHKGIRKVYACSHCPDSRRTFTKRLMLEKHVQLMHGIKDPDLKEMTDATNEEETEIKEDTKVPSPKRKLEEPVLEFRPPRGAITQPLKKLKINVFKVHKCAVCGFTTENLLQFHEHIPQHKSDGSSYQCRECGLCYTSHVSLSRHLFIVHKLKEPQPVSKQNGAGEDNQQENKPSHEDESPDGAVSDRKCKVCAKTFETEAALNTHMRTHGMAFIKSKRMSSAEK

SEQ ID NO: 782817 - protein, 1299 aa, Homo sapiens; identical to SEQ ID NO: 782816

SEQ ID NO: 782818 - protein, 1299 aa, Homo sapiens; identical to SEQ ID NO: 782816

SEQ ID NO: 782819 - protein, 1299 aa, Homo sapiens; identical to SEQ ID NO: 782816

SEQ ID NO: 782820 - protein, 1031 aa, Homo sapiens
MGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFRSNVLTGSAPQQDYDKLKALGGENSSKTGLSTSGNVEKNKAVKRETEASSINLSVYEPFKVRKAEDKLKESSDKVLENRVLDGKLSSEKNDTSLPSVAPSKTKSSSKLSSCIAAIAALSAKKAASDSCKEPVANSRESSPLPKEVNDSPRAADKSPESQNLIDGTKKPSLKQPDSPRSISSENSSKGSPSSPAGSTPAIPKVRIKTIKTSSGEIKRTVTRVLPEVDLDSGKKPSEQTASVMASVTSLLSSPASAAVLSSPPRAPLQSAVVTNAVSPAELTPKQVTIKPVATAFLPVSAVKTAGSQVINLKLANNTTVKATVISAASVQSASSAIIKAANAIQQQTVVVPASSLANAKLVPKTVHLANLNLLPQGAQATSELRQVLTKPQQQIKQAIINAAASQPPKKVSRVQVVSSLQSSVVEAFNKVLSSVNPVPVYIPNLSPPANAGITLPTRGYKCLECGDSFALEKSLTQHYDRRSVRIEVTCNHCTKNLVFYNKCSLLSHARGHKEKGVVMQCSHLILKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQQMKKHPCRQCDKSFSSSHSLCRHNRIKHKGIRKVYACSHCPDSRRTFTKRLMLEKHVQLMHGIKDPDLKEMTDATNEEETEIKEDTKVPSPKRKLEEPVLEFRPPRGAITQPLKKLKINVFKVHKCAVCGFTTENLLQFHEHIPQHKSDGSSYQCRECGLCYTSHVSLSRHLFIVHKLKEPQPVSKQNGAGEDNQQENKPSHEDESPDGAVSDRKCKVCAKTFETEAALNTHMRTHGMAFIKSKRMSSAEK

SEQ ID NO: 782821 - protein, 1136 aa, Homo sapiens
MGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFRSNVLTGSAPQQDYDKLKALGGENSSKTGLSTSGNVEKNKAVKRETEASSINLSVYEPFKVRKAEDKLKESSDKVLENRVLDGKLSSEKNDTSLPSVAPSKTKSSSKLSSCIAAIAALSAKKAASDSCKEPVANSRESSPLPKEVNDSPRAADKSPESQNLIDGTKKPSLKQPDSPRSISSENSSKGSPSSPAGSTPAIPKVRIKTIKTSSGEIKRTVTRVLPEVDLDSGKKPSEQTASVMASVTSLLSSPASAAVLSSPPRAPLQSAVVTNAVSPAELTPKQVTIKPVATAFLPVSAVKTAGSQVINLKLANNTTVKATVISAASVQSASSAIIKAANAIQQQTVVVPASSLANAKLVPKTVHLANLNLLPQGAQATSELRQVLTKPQQQIKQAIINAAASQPPKKVSRVQVVSSLQSSVVEAFNKVLSSVNPVPVYIPNLSPPANAGITLPTRGYKCLECGDSFALEKSLTQHYDRRSVRIEVTCNHCTKNLVFYNKCSLLSHARGHKEKGVVMQCSHLILKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQKTCTICQMLLPNQCSYASHQRIHQHKSPYTCPECGAICRSVHFQTHVTKNCLHYTRRVGFRCVHCNVVYSDVAALKSHIQGSHCEVFYKCPICPMAFKSAPSTHSHAYTQHPGIKIGEPKIIYKCSMCDTVFTLQTLLYRHFDQHIENQKVSVFKCPDCSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKQMKKHPCRQCDKSFSSSHSLCRHNRIKHKGIRKVYACSHCPDSRRTFTKRLMLEKHVQLMHGIKDPDLKEMTDATNEEETEIKEDTKV

SEQ ID NO: 782822 - protein, 1299 aa, Homo sapiens; identical to SEQ ID NO: 782816

SEQ ID NO: 782823 - protein, 1299 aa, Homo sapiens; identical to SEQ ID NO: 782816

SEQ ID NO: 782824 - protein, 1299 aa, Homo sapiens; identical to SEQ ID NO: 782816

SEQ ID NO: 782825 - protein, 512 aa, Homo sapiens
MLLPNQCSYASHQRIHQHKSPYTCPECGAICRSVHFQTHVTKNCLHYTRRVGFRCVHCNVVYSDVAALKSHIQGSHCEVFYKCPICPMAFKSAPSTHSHAYTQHPGIKIGEPKIIYKCSMCDTVFTLQTLLYRHFDQHIENQKVSVFKCPDCSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKQMKKHPCRQCDKSFSSSHSLCRHNRIKHKGIRKVYACSHCPDSRRTFTKRLMLEKHVQLMHGIKDPDLKEMTDATNEEETEIKEDTKVPSPKRKLEEPVLEFRPPRGAITQPLKKLKINVFKVHKCAVCGFTTENLLQFHEHIPQHKSDGSSYQCRECGLCYTSHVSLSRHLFIVHKLKEPQPVSKQNGAGEDNQQENKPSHEDESPDGAVSDRKCKVCAKTFETEAALNTHMRTHGMAFIKSKRMSSAEK

SEQ ID NO: 782826 - protein, 123 aa, Homo sapiens [sequence omitted]

SEQ ID NO: 782827 - protein, 40 aa, Homo sapiens
RFGIWKVLVFQAPDRIWAWVVLFPWDILLICNQCNPLLID

SEQ ID NO: 782828 - protein, 56 aa, Homo sapiens
MLWALENAGPNGVVTEIHTALQGKAPAHSPQEETESESTNHRCLYNCGASDSQGNV

SEQ ID NO: 782829 - protein, 68 aa, Homo sapiens
PLSLQGHFSVHTASQENNAQHVGPQAGALSRGGGLFKGGLRNNDRASKENATGAGLHVPSTRYLELDY

SEQ ID NO: 782830 - protein, 68 aa, Homo sapiens
KWLSASSERWKVPGVTGMGMKRDEGCRWACGFIACGPFHWPTFSTSARKAFKEGFENQPAIFTISSDG

SEQ ID NO: 782831 - protein, 103 aa, Homo sapiens
TTGWHKGVWGVVEAFCIPTVLVIIHIHACEETHTLYPPAKNQCVSPNCCTCSTQPSLSLVIHPVPSQPPRPFCQVPNTCGHFYFLAGHNHAQPFAQEPLLPTF

SEQ ID NO: 782832 - protein, 83 aa, Homo sapiens
YPRAAGKVPGSKFKHVGTSSSLSSYPRIFPDNRSLIPWQSSWGESAQHCKKAVLLQEKLQQRRGMRVNQPRNNGLFRSSIAKL

SEQ ID NO: 782833 - protein, 96 aa, Homo sapiens
RAPCTDGVYVRKWTLKNFQMFGRARWLMPVIPALWEAETGGSQGQEINTILANTVKPYLYKNTKKCTVLPMAHLLTSFKSLQKCHCLKEPYFDQHI

SEQ ID NO: 782834 - protein, 41 aa, Homo sapiens
RACFGNYGCDLVLSQQGQPIPAANICSSSECSKENTRSTAE

SEQ ID NO: 782835 - protein, 175 aa, Homo sapiens
FPSPVGPSPLHSSYHLPLHSSYRKSHVGTDGHHQRGCLAAAHGPPSSSILSFGWFSLLLLSSHPGFNSTSCPSFTEKTEATGTHSILVLLSLSSILLPILHSRKPFTFFPLFSEEVSPFSYSRQFPHLVLGPGLLSIHAPSSVSPVSLSHSQIHVLNQKIHPSFPPPPSSPQEKK

SEQ ID NO: 782836 - protein, 68 aa, Homo sapiens
PSPSSSPFIITVITVIITIIITTTTITITIIVIIITVTTITITVTNIMVLLNLWAALGRAGHGTFLVS

SEQ ID NO: 782837 - protein, 67 aa, Homo sapiens
MVKHTSLKMCCFTIWKGTVERREARSHCCATVATIHLQNLLSPQTETLSPLNPDPQRLVTSFLLSGS

SEQ ID NO: 782838 - protein, 42 aa, Homo sapiens
MNWDCLLLPSAVELGSVVRSLRPVCLSRFFISRVVVVESNDL

SEQ ID NO: 782839 - protein, 67 aa, Homo sapiens
SAFPATLSSPEGLAPRERTRFTATFHCPEHFPAPTGARKYLGMKERPPPTGWGGLQGGLWRIHNSQC

SEQ ID NO: 782840 - protein, 46 aa, Homo sapiens
MGICLLDLGMGIKKSLGSSIRNVTETPESWLVGAGRRCGGGGGGRG

SEQ ID NO: 782841 - protein, 107 aa, Homo sapiens
RYILVFGLGKRFCFCRHVFQRLGGPVLASPLSPSPSGTFLPWMAFPVCPGLCCSHYESPALTATVADAQGVGDSDSAQQAVFMCCSSVHPELSSRSSFINLSHASHT

SEQ ID NO: 782842 - protein, 87 aa, Homo sapiens
PAALRTAPPAPPWATARAAATSSGSTPTSRTRSGARRYWVRKIAPEYYDHLPQHHSWVKVLWDFVFEDSLGPYARVKRVYRLAKDGL

SEQ ID NO: 782843 - protein, 334 aa, Homo sapiens
GRAPNGASRPTMGNSASRSDFEWVYTDQPHTQRRKEILAKYPAIKALMRPDPRLKWAVLVLVLVQMLTCWLVRGLAWRWLLFWAYAFGGCVNHSLTLAIHDISHNAAFGTGRAARNRWLAVFANLPVGVPYAASFKKYHVDHHRYLGGDGLDVDVPTRLEGWFFCTPARKLLWLVLQPFFYSLRPLCVHPKAVTRMEVLNTLVQLAADLAIFALWGLKPVVYLLASSFLGLGLHPISGHFVAEHYMFLKGHETYSYYGPLNWITFNVGYHVEHHDFPSIPGYNLPLVRKIAPEYYDHLPQHHSWVKVLWDFVFEDSLGPYARVKRVYRLAKDGL

SEQ ID NO: 782844 - protein, 333 aa, Homo sapiens
AGAEALSVVTGKIQDKLPEPQGDPGAPSPSHRAARLQAKYPAIKALMRPDPRLKWAVLVLVLVQMLTCWLVRGLAWRWLLFWAYAFGGCVNHSLTLAIHDISHNAAFGTGRAARNRWLAVFANLPVGVPYAASFKKYHVDHHRYLGGDGLDVDVPTRLEGWFFCTPARKLLWLVLQPFFYSLRPLCVHPKAVTRMEVLNTLVQLAADLAIFALWGLKPVVYLLASSFLGLGLHPISGHFVAEHYMFLKGHETYSYYGPLNWITFNVGYHVEHHDFPSIPGYNLPLVRKIAPEYYDHLPQHHSWVKVLWDFVFEDSLGPYARVKRVYRLAKDGL

SEQ ID NO: 782845 - protein, 107 aa, Homo sapiens
FCPQKLRTHLPGQCLLRVLAPTPHALQELLPSHLSSFLFSTTAAQLGLQIDSNPSSLTLKKGKDGKGRRMGMKRGPPSFSSNRISFPCPHAANVPGTASAWGAAGKD

SEQ ID NO: 782846 - protein, 112 aa, Homo sapiens
MRWLLGTAVGGSHVSCVSSEESSSAATALKAASPTQISPRQISPQQISAASLDMASVPWTSRAASPHLLSQVSTPGPLCDLRAPLAANSGLFPLGLQHLGPLLEHPDIPEHP

SEQ ID NO: 782847 - protein, 223 aa, Homo sapiens
MGYGDGPGRLEVPGSLAGIGHEAGPRGHKAMGHRSGYWVASEGDTNSKDGPERARETRLVDGAGPGVEPVMAGMPGTAGGMAHRDSLRGTGVLGSQGGRQTLSDERGSTKDLGGYGTSGIPEASEAAGAKGKPDVKEWQDSSGTPGSSRDRGAPRVKDRSPDQAGIMGASGFLDGKGAVEGETWAGMAALGSGYERDIWKAGPGMTDRGRVAGQGGLASQGGG

SEQ ID NO: 782848 - protein, 55 aa, Homo sapiens
MWIYGVTAKEQQTLNDDETRQKEPGSFDDIMDSICSNSLDCLPVQTFTSGRNFPC

SEQ ID NO: 782849 - protein, 72 aa, Homo sapiens
LLIICFSHSVPHQRKKHPTAQAITEVILDSSFTLIPHPNHQQVIISTTSKIYLKSTHQYTQHHNQLLPQLSR

SEQ ID NO: 782850 - protein, 116 aa, Homo sapiens
DSLRLVAVREGPGKSCRPGCLRQAVTQQAKAEWAGVEGSCLGRVGYAADAPECVGSVSKPRIWVPGRARVTRDRVSMRLTEGPVSGHLSPCHALPRAHAWHRPPSPGLRAAPSPLL

SEQ ID NO: 782851 - protein, 119 aa, Homo sapiens
DLSPPCPANFCIFVETGFHHIARAGLELLSSNDLPVWASQSVGITGVKHSTWPVISIFFSLLLSLFSRCPTMNTHGFYKKEKKAYTFANCIKLSKHRKEQKYGEISIFKHCGLGTVAHI

SEQ ID NO: 782852 - protein, 39 aa, Homo sapiens
LLVYISTLQDWITDSLFRPESHSIPFYYVSLKFYYLLMV

SEQ ID NO: 782853 - protein, 69 aa, Homo sapiens
RWNLALLPRMECSGMILAHCNLCLLGSSNSPASASQETGITGTHHHTQLIFVFLVETGFTMLARLVLNS

SEQ ID NO: 782854 - protein, 287 aa, Homo sapiens
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPK

SEQ ID NO: 782855 - protein, 144 aa, Homo sapiens
ASRSGWSPGRCKACPAGSPSVPRPRPAMLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLTWRQVYQFAPETFAPA

SEQ ID NO: 782856 - protein, 126 aa, Homo sapiens
MIMNVFVATPCSPPDCLGSFPVGLDLEMGVCCWRRGPSGSVEGLCFHGCSLREWPPGCALSGREAGLRWNEPRISRMAFAAALILVLACPFPRVFPKTVFFSWGEAQHCFIWLLANTYTLLEGSGF

SEQ ID NO: 782857 - protein, 114 aa, Homo sapiens
PCPGSNHVTQTWPPTIFHCPCHSDWFTDGCETQAKPTKVLSGTSGAAGRTLALSLDHKPSCCYLETACLGNCAGRGKWTRQERETQLYEHYLNTWMQLCLNSTNVNLLSPEMIW

SEQ ID NO: 782858 - protein, 104 aa, Homo sapiens
RCPSHTEPQNLTGVSEFLLLGLSEDPELQPVLAWLSLSIYLVTVLGNLLIILAVSSDSHLHTPIYFFLFNLSLADIGFTSAMVPKMIVDMQSHSRVISYAGCLT

SEQ ID NO: 782859 - protein, 35 aa, Homo sapiens
GERLDVFSRDQEQDKDTTFPISIEHCTGSSARPIR

SEQ ID NO: 782860 - protein, 110 aa, Homo sapiens
MSWDLLVLTLGKGCSALLIIDQLCLKSQVPALCEPVSFVFTTTWICGFYPNQPPLTKHDCGLQGDHLRRDEWICTEPSLIWKTTQSQLLCLKTTQSWWWGSVIAWRGSGE

SEQ ID NO: 782861 - protein, 110 aa, Homo sapiens
MEHPTTQHCLPSESLSPQQKHNQRLPQLAGLIQAEETWGSFPGMLQQIRVLPKVWQAPEDSIPKAEYSYLVSVAPAGPSGRSPGGKGKEVEAEAEAPVLGGGYQARKTRP

SEQ ID NO: 782862 - protein, 72 aa, Homo sapiens
TTTTTVTIIITTIIIFFTSCSLQVPKQVPDQLIRWDLPTGLHTCWASDIQLLHRAALFCFAVSILHVIVGFS

SEQ ID NO: 782863 - protein, 70 aa, Homo sapiens
HRVSAWESHGPDLWRSTLAKKHSDRTTSLPPNSLHKSNMSPTCDGQGLGGSAGGGGNNPDLVAEKKNTYY

SEQ ID NO: 782864 - protein, 70 aa, Homo sapiens
RVCCRNQCPSGGLAFGGFQFPQKRRLSAGPLCFHRLPVYRKLCFPDTYYLIRKPENTESGVKAKSPASLQ

SEQ ID NO: 782865 - protein, 102 aa, Homo sapiens
MSCFSLIMPVYCLLKQSMVSMRSGNQAFLQCSARQLVGWASTRLTPVQCSSSSILPLSCKTRPPPPGQPPSALQLRTTLPHDALLLPQDSISGIHSNTKNSN

SEQ ID NO: 782866 - protein, 161 aa, Homo sapiens
PPPTQTLTPLSAVRDSAIAPKPHHVFSRPLEIARRLSQYFVANRPIPFDANRVRFLPTSFEFNATASFIPPAITFVLMTMVTLKGVLNMAEPENARSFFSGSPLEEEPLAPQEPYFGLTFNTTWKPPRLTECAFQSCDLNCTWGLLSEAGTGVAWMQRAVS

SEQ ID NO: 782867 - protein, 33 aa, Homo sapiens
PWVYPWVEMDQNSKSRAKKSQVGPPVAQASITA

SEQ ID NO: 782868 - protein, 118 aa, Homo sapiens
QGWSQAENSHPHSDGCADGAALEGGGGSCHSQGKVGVKGRRGRAAGLRPGDCRLLRAASGRVSFLQLRAAHLPPLFPHFCSARLSLKNLAPHAPAVLGFLVPPSLGLLPSSACSKTPE

SEQ ID NO: 782869 - protein, 125 aa, Homo sapiens
TLDGSPVVTHRVGPTHRIYPMCGGWKCQGFLIEKGNKRLCHSQHRSGMSPTMVYTCASVCLCLCHLHVFLCQCLCVCAYVVCLRVCTCVYVCVHVSACMCVSLCMCLCMCCMCVYVVSVSVCVLC

SEQ ID NO: 782870 - protein, 116 aa, Homo sapiens
SLSPALDGSATIPFDHVNDHYADCERSLFTSQSAAACPTGSFHCTNTGYKPLYIPSNRVNDSLFVSCCDGTDELYSGVICENTCPESGRVERESLPQKCACGAHPGTPLGRCHSCP

SEQ ID NO: 782871 - protein, 45 aa, Homo sapiens
LTNRTAFALLVHALTVSSASMGPDSRVPTSQPHLQPCPIYLAIPQ

SEQ ID NO: 782872 - protein, 156 aa, Homo sapiens
GASARPPPPQGAQVWPKLRVVTLLEHPFVFARDPDEDGQCPAGQLCLDPGTNDSATLDALFAALANGSAPRALRKCCYGYCIDLLERLAEDTPFDFELYLVGDGKYGALRDGRWTGLVGDLLAGRAHMAVTSFSINSARSQVVDFTSPFFSTSLGI

SEQ ID NO: 782873 - protein, 133 aa, Homo sapiens
MVIPAALKAEHLKPTRKFACLGHLSHKVDWKYQAVIATLEEKRREKAKIHYQKKQQQKQAQKNGEKKIASSQGSSRPMGFWSEPIKTVYSSKTNKQNKEAECKTGGQPFREAPGCPGKRLSSAGLSISLGPAP

SEQ ID NO: 782874 - protein, 168 aa, Homo sapiens
MIVYLGNPTVSAQNLLKLIGNFSKVSGYKINVQKSQAFLNTNNRQKESQIMSELPFTIASKRIKYPGIQLTRHVKNLFKENYKPLLDEIKEDTNKWKNIPCSLVGRINIVKMAILPKVIYRFNAISIKLPMTFFTKLEKTTLKFIWNQKRARIAKSILSQKNKGGGIT

SEQ ID NO: 782875 - protein, 70 aa, Homo sapiens
PGRGQGPRSLPGKGQMQACAILEQARPGVGAVATDSFSGSEMGTDERVTALLVELRAIMEADRHPGSPDS

SEQ ID NO: 782876 - protein, 114 aa, Homo sapiens
MKLPFCVLSQYLQVLDVPQRPPDMFTTNFSFPLSLTLGALPGLGWPAQAVIPPPNTQIPGCPLGSLLLPDQPPTPSIPTPVLILFSASILVQTLLNLTPTICPLCGRPSARSKI

SEQ ID NO: 782877 - protein, 35 aa, Homo sapiens
KFTNTSSNNQDSTVSLRCPCNHVFDEVSVSWGIND

SEQ ID NO: 782878 - protein, 102 aa, Homo sapiens [sequence omitted]

SEQ ID NO: 782879 - protein, 118 aa, Homo sapiens
MLITLRAKKCLAVFSFTRCTLVDSDVGIGWKAPMEGKERHAGHPCLRHLGGNGITLLEWSEYLVSSQIPMLDPHPQGDGVRCCVLWEVMRVKSHEWDECPYKRDPREIPHPFHHVRTQ

SEQ ID NO: 782880 - protein, 154 aa, Homo sapiens
PDHTSRLAPLQDSPFASGQPLYPQTQLSGPLHHKTSTFGPQFKANTHRPSIQTNSAPGWPSHSQALGLSQCHVDTHGPQLQAGPHGHRYQVSIQTFSLQYSPHGYRLQAIPGGPRFQAGPFKLRLQAQTRLQPSPKKADPQSPRLQARPRTKLA

SEQ ID NO: 782881 - protein, 144 aa, Homo sapiens
FLLVRTCAYVFLWTGTCQGGLLAFLGNFSFPATPPVSMDIPRILPLALLVLSLHSSLLGTCGFSHLLPADATQVPACRFIFPPARGEEIHNLDVYRGRIQNKQVTFNLLLLHQPLLLHDEGSHTTELPPKLQVGPEAPLFLWPF

SEQ ID NO: 782882 - protein, 104 aa, Homo sapiens
KNGENVFSIQIKQGVTGTAPQSRGLALPRRRSPESTPGGLEGCFAQIECGAAIGNGSPVLSCSYLLYISCVFLTQCGDVPTAEWFCPTLLGPLLLHATLTTTQT

SEQ ID NO: 782883 - protein, 40 aa, Homo sapiens
MMFRSDRMWSCHWKWKPSPLLFLFALYIMCVPHSGKTLPL

SEQ ID NO: 782884 - protein, 79 aa, Homo sapiens
EDPAFRPISFLSSHYICPGSSISINPFLMGARFHLSSHQPISKSASLSAVVQSWLTAISASQVQAILLPQPPWLLGLKV

SEQ ID NO: 782885 - protein, 77 aa, Homo sapiens
LSLLFSFSCWRPLSPDTQVYQYSSFGPKWTPAAPLTQSLHQPRISTKPEFPPSQGFHQSRTCNNPELPPTQSFRQSR

SEQ ID NO: 782886 - protein, 102 aa, Homo sapiens
SGTHCVCGWEAGASAHVAATSKDMSTRTHVSIAPSTCHLIWQALTRPLELLAGLARRWMGGLTGDSAGRFLFQVGAGEVRPGVPSEREPGCGTEIVSSQPII

SEQ ID NO: 782887 - protein, 139 aa, Homo sapiens
MAARTDTLMFPSGRTWLWVDTGLGTGLEPQHSRGMAGILRIPEGPVGSFQSPRGLCLPPNPHWECCVDFIRTQQRLRPGLSVSPGPSSSGCFPGPYRAHPAKACTFLGQTPPGDRASQEAHPREQGGGVSHIIFCLSQS

SEQ ID NO: 782888 - protein, 102 aa, Homo sapiens
SRRILSSTYRTCFYIRLLVLFIFGSGRLPCSLGGWGGRDCYVFTKAHFLLHFFCCRWYGFESWSVDCGKRRHKPLLGLVLKTLLQVPLHSPKPHAHWLDTEC

SEQ ID NO: 782889 - protein, 61 aa, Homo sapiens
MQIYDPWVKNEIKMEIKKFFELNNNSDMTYDNLWDTAKGVLRGKCIALNTYIKRSERAQMD

SEQ ID NO: 782890 - protein, 56 aa, Homo sapiens
FDPRVEALGYSTFEKVVQGADNALGVWGGRSQTQLPLDVGGGNGSLVPQISDLGAP

SEQ ID NO: 782891 - protein, 52 aa, Homo sapiens
MAGVTALSVDDGSGETGILTFTSHPLGYLQGRQLRALYLSRNPRLKDQMEPS

SEQ ID NO: 782892 - protein, 70 aa, Homo sapiens
PVFYFFTVALITIYNYGFFPLQCLSSGFLTDVHTKKSRIISVLFTILDGCPGPELEIKSQHIWVEGKTFF

SEQ ID NO: 782893 - protein, 56 aa, Homo sapiens
MTKQPVWREELLTPGSPLCSELNTHWDTLAVERSYPLWVSSELFCHPIKLLFTLLT

SEQ ID NO: 782894 - protein, 107 aa, Homo sapiens
RKNTTGRLYTPCNTDIRNNITGQEYTPCDICGEERSIRRFMKMHKWKIMMVFFMAAAAELQRGMFIQESFLKQKQQFHGQSERQWQMAAGCWKKWKKKTRKCCRDFA

SEQ ID NO: 782895 - protein, 52 aa, Homo sapiens
REEWNSQEELWTGSLRSLRVVNKKNAEKGDKHKPRQLAMFQMQFVVVKPQAK

SEQ ID NO: 782896 - protein, 55 aa, Homo sapiens
MAWPGAHICAPDHVMCFQLETRGLLRAGACCVDHSVECVEIYRRMRNGPDGRACG

SEQ ID NO: 782897 - protein, 30 aa, Homo sapiens
MRSGSLEWGQAEGCGVTDTWHFQALCGAWR

SEQ ID NO: 782898 - protein, 87 aa, Homo sapiens
DSRGYTDDAENPICSLAGFRELRKPPFETESRSVAQLEEGSNIVTLTYRGQVPEGFLHHISVEILLGRIQQSPLLLGEAHIYILKDH

SEQ ID NO: 782899 - protein, 63 aa, Homo sapiens
LAVTVGGGCLGSCGWLWGGVGHLLPLLKQSLCYPWHGRSLVDPIKRNRDSPTVRRERVATVYE

SEQ ID NO: 782900 - protein, 67 aa, Homo sapiens
PGVFADIWGQAGEGARRRGAGHGTLYMLTGTHRSARVHTQADEEVHTSQPHRPTRYQGLHSKGMTWG

SEQ ID NO: 782901 - protein, 112 aa, Homo sapiens
MAGEMGTHRYFIFIVLGVSIFNLQIELQTLVGFLLGLLRTFRTHLHCHVQSAPVPLIAASSSLGCTPTSDLSTPCHGHLIAVNSRPPQTMLTRPSYRPTLSLGCVSVAGEGL

SEQ ID NO: 782902 - protein, 462 aa, Homo sapiens
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGVIYGRGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEFPFPVNIILSNPWLFEPLISRFMERNPLTNAIIRTTTALTIFKAGVKFNVIPPVAQATVNFRIHPGQTVQEVLELTKNTVADNRVQFHVLSAFDPLPVSPSDDKALGYQLLRQTVQSVFPEVNITAPVTSIGNTDSRFFTNLTTGIYRFYPIYIQPEDFKR

SEQ ID NO: 782903 - protein, 502 aa, Homo sapiens [sequence omitted]

SEQ ID NO: 782904 - protein, 85 aa, Homo sapiens
KSSGKPCGQVCESGLSFCNPDLSFLISKRGRMVPRAWSSEEAQDVTHRSSPKVSTLLSEQPVFCTDACLRYVMVREKRYRFHGET

SEQ ID NO: 782905 - protein, 33 aa, Homo sapiens
MNSSHPGFVSPVKSSNLSYTENFLNKNLASLAS

SEQ ID NO: 782906 - protein, 351 aa, Homo sapiens
PGGVLAGSYPEGAPAVLADKRQQFGSRFLRDPARVFHHNACNHPAPSPGLSLAVCPAASEHSEKPLTAGHESSCPTRPRVKLPYPRHSPRGEKLLGQRLTLLSSQDVKPLSCPFDFLRDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRVFCLCSQTCVDDKKEFPVAQGGGYYNSFLNLRHCSEQC

SEQ ID NO: 782907 - protein, 275 aa, Homo sapiens
EPGGVLAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRVFWLCSQTCVDDKKEFPVAKGGGYYNSFLNLRHCSEQC

SEQ ID NO: 782908 - protein, 127 aa, Homo sapiens
GGNARATLLWEKSQHASLPFQIPSDLLPLAFLLPQWGFSTTDRCFPVLCGQGTHVVKHSGVWLCKEVKSTMQISRSPNPGQMAVTEAHAPPPSCATLGQVTSPLWASTSSLERQNANIHPASCQDVL

SEQ ID NO: 782909 - protein, 450 aa, Homo sapiens
LQELGAGPRPQGPPRLPAPPGALSTGPVLGPVHPTPPPSSPQEPKRPSQLPSPSSQLPTEAQLPPTHPGTPKPQGPTLEPPPGRVSPAAAQLADTLFSKGLGPWDPPDNLAETQKPEQSSLVPGHLDQVNGQVVPEASQLSIKQEPREEPCALGAQSVKREANGEPIGAPGTSNHLLLAGPRSEAGHLLLQKLLRAKNVQLSTGRGSEGLRAEINGHIDSKLAGLEQKLQGTPSNKEDAAARKPLTPKPKRVQKASDRLVSSRKKLRKEDGVRASEALLKQLKQELSLLPLTEPAITANFSLFAPFGSGCPVNGQSQLRGAFGSGALPTGPDYYSQLLTKNNLSNPPTPPSSLPPTPAPSVQQKMVNGVTPSEELGEHPKDAASARDSERALRDTSEVKSLDLLAALPTPPHNQTEDVRMESDEDSDSPDSIVPASSPESILGEEAPRFP

SEQ ID NO: 782910 - protein, 103 aa, Homo sapiens
SHGPRAVMSAAVNFVSMGAKLKFLLSFLGRVRSSEQRELEHKDRLGGCGEVSGDAEQRGDHFFPVWPQRKATLPSWYCFVTSVSCLCDCFPTGALRARLLERL

SEQ ID NO: 782911 - protein, 64 aa, Homo sapiens
WSQGIPRGQSLPEHSKASVLVAGSLGRRTLGQLRALGFFKAPCGWTGLYRLPALGVWPACGDCA

SEQ ID NO: 782912 - protein, 79 aa, Homo sapiens
GPGCNRCPGTTPPDAPTRAGQDPQTWSCVLLPECGARPAMEKPTRVVGGFGAASGEVPWQVSLKEGSRHFCGATVVGDR

SEQ ID NO: 782913 - protein, 70 aa, Homo sapiens
LCGRTLRLGVHFITCQRNTVNFRKIQGITMYFPQIIINQYFGHTSYKNLKLAKTTLLFSLHSTSPRVVTI

SEQ ID NO: 782914 - protein, 164 aa, Homo sapiens
QACWVGRNCSPSELRMAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETIGKSM

SEQ ID NO: 782915 - protein, 109 aa, Homo sapiens
MYSKLRMMWQSDGNRKQNINPRDQEGIKYHLIPTWTLHLKEEKLMMTLGLLAVVVSPFLHYYYYYYYYYYYFWRRSPALSPKLECSGAILAHCSLPPRVQAILWPQPPE

SEQ ID NO: 782916 - protein, 72 aa, Homo sapiens
GHGTSAGALGCQAMPQGLQARFHRSLSQKSCPSNASPWPGHRCQDRAIIFCSFFGVPETGQGILHCVSVCVS

SEQ ID NO: 782917 - protein, 59 aa, Homo sapiens
DKPARKVPGLLLGHCKQAEIIQTLSSDKRPSPLDIHLEKHYWSRGVSHSLVTHIMDAGA

SEQ ID NO: 782918 - protein, 163 aa, Homo sapiens
KRCKESCFYESRRFPKDLTPSPSISAGMVWLCRGEGASLKCFGENLLTWRGVCLPVHLNLIKFALSLERHVWGIKLIEILKYSNVVENLWLCKYPQNSLCWSNMKSRWLCSSLPTGLRGAGEGDLSNIKEKGQRGARTHSGPFLDPSQGRRAREAHSDYGPSL

SEQ ID NO: 782919 - protein, 136 aa, Homo sapiens
SCECVWPPVCFRMVRAKFFTVWKGDLGTFSQVTSHLCSVMCSCEHSRVAVLGSHKASWCPGYRMLSQNPSGAPHLSPHFGWGSCFPWVDPKIPADLEGSELRAPPAVLAQVSSFCYYMPRPSWPRLEAPRVQKTGA

SEQ ID NO: 782920 - protein, 426 aa, Homo sapiens
EEARGGRLRWRRLDDCLSAAESDTVAYEDLSEDYTQKKWKGLALSQRALHWNMMLENDRSMASLAGRNMMESSELTPKQEIFKGSESSNSTSGGLFGVVPGGTETGDVCEDTFKELEGQPSNEEGSRLESDFLEIIDEDKKKSTKDRYEEYKEVEEHPPLSSSPVEHEGVLKGQKSYRCDECGKAFYWSSHLIGHRRIHTGEKPYECNECGKTFRQTSQLIVHLRTHTGEKPYECSECGKAYRHSSHLIQHQRLHNGEKPYKCNECAKAFNQSSKLFDHQRTHTGEKPYECKECGAAFSRSKNLVRHQFLHTGKKPYKCNECGRAFCSNRNLIDHQRTHTGEKPYKCNECGKAFSRSKCLIRHQSLHTGEKPYKCSECGKAFNQISQLVEHERIHTGEKPFKCSECGKAFGLSKCLIRHQRLHTSE

SEQ ID NO: 782921 - protein, 131 aa, Homo sapiens
LHTYHGCRKEDRKKSSDFFSSISGTWISLNLCHRPLSSSQPLQSSLPTPNFSGLSLSRIEYTPPPRASGAPQSGRDKGLPLQSTPLPPDPCQCSPTHALRSCQPELQAAWLLQPLHRLLPLPGMPTPSLSH

SEQ ID NO: 782922 - protein, 124 aa, Homo sapiens
MAPLNSSLKDKARLYLKENVNHMPAAQATPQSPLAIPPYHFHMGFHWCQISSLIPNLTLAFLPQISSSLLGLLTLAKTLSPKQLLKPKTWGVILYTSLSFTTPSNPTPSPFQILPHCSISLPLE

SEQ ID NO: 782923 - protein, 102 aa, Homo sapiens
MASYNAFLLGFVDEGQKCRWQRGLIGGHVKIRDWESLRPPFLAYHCSSPNWEDYNEEQAGTQVAGHGDAPKWLCLPLPTGKLREEWREGGRSHNFGGSRWVR

SEQ ID NO: 782924 - protein, 104 aa, Homo sapiens
MSSHPESQNLVSHSGLSSPLTIAPKDIKILLNSLPQVSWYFLFPFCACSNDLIGSLMVFFLNTARPLVLLSMNSSSTPQPVIHLLCTSDYTTGGWENVPWANQQ

SEQ ID NO: 782925 - protein, 253 aa, Homo sapiens
LSFNFVLGAVSPAVVVLYTMVLQENGYGVEKDIPTLLMAASSMDDILALTGFNTCLSIVFSSGGMLNNAIASIRNICISRLAGIVLGIFVQYFPSEDQKKLTLKRGFLVLTTCVSAVLGSQRIGLHGSGGLCTLCVEFHCEDKMVRRKEMTSHHVAQAGMELLRSSTPPSLGFQSASDNKGVVTAASRWRHLLLNIDPMQPATNEEFPQFVRCNGEQNLELVGALMVSNVLVTSDWLARYDSNDEDDNNVTPG

SEQ ID NO: 782926 - protein, 153 aa, Homo sapiens
SSLTPFLTRPPAPDEQSIWNVTVLPNSKWANITWKHNFGPGTDFVVEYIDSNHTKKTVPVKAQAQPIQLTDLYPGMTYTLRVYSRDNEGISSTVITFMTSTGERGPGLAIPCKHGAFHSHPQLPACLSPRKEDSSPTPFPTLHGVSQLLLCIS

SEQ ID NO: 782927 - protein, 153 aa, Homo sapiens; identical to SEQ ID NO: 782926

SEQ ID NO: 782928 - protein, 109 aa, Homo sapiens
FSTIYYELLSVYYVYYEVLSVVLGDGLDNGVSSALSYLFHGCGGTLLSGAGSPCLPMKTQMVTVGANPDKGGCAELLVKFTEVCVRFEGAALASRLRQKCDVFPLKLLS

SEQ ID NO: 782929 - protein, 76 aa, Homo sapiens
TPKMSWNTQDGALTCLPVDVDYWLGFQLGLSTVATTHSLCMWLELPQHGGWVLRDSVPTASVLRVSKQKLPVFLKS

SEQ ID NO: 782930 - protein, 69 aa, Homo sapiens
VSQGKLEAAPQPFLPQSSCAKVTKGGGEHRHCQALGWKVTHDISVRITGGPWFWVWTSWRAVLVPTPMP

SEQ ID NO: 782931 - protein, 85 aa, Homo sapiens [sequence omitted]

SEQ ID NO: 782932 - protein, 178 aa, Homo sapiens
SILPVIDNHVPPGLRRFYGSVVVPVCKDMHLLLWLQKRIEMHKAEQCEEEEAMTPRPTKARAPLPSAYVPPLSLPPCPRERLKGMLKEIKPRLSRNCREDPQGCLLNLLLQSHSRSPERPLQRRERRYLQRRREKLMLARRGITLQKMEMPKQTRHRKLKVLEMPSEVCAFLITVYFW

SEQ ID NO: 782933 - protein, 167 aa, Homo sapiens
FSALDFADESGSVSCKDMHLLLWLQKRIEMHKAEQCEEEEAMTPRPTKARAPLPSAYVPPLSLPPCPRERLKGMLKEIKPRLSRNCREDPQGCLLNLLLQSHSRSPERPLQRRERRYLQRRREKLMLARRGITLQKMEMPKQTRHRKLKVLEMPSEVCAFLITVYFW

SEQ ID NO: 782934 - protein, 150 aa, Homo sapiens
AGITGMQPLGPANFVVLVETGFLYVGQAGRELPTSGDPPTSASQSAGITGVSHCTRLHYHLSFSLVYKEDQTPSASLPNTWQTHLYQFHPYLLSFLRGGTVLFLFEGLSLHVLTLISSLLRSWDLTLLIDLFIYSLSLFLSSSTSHLTLG

SEQ ID NO: 782935 - protein, 93 aa, Homo sapiens
LPNNHKTDILPKCTQNIYRGQPYSGPYNIKGFKLYTKIFEKCLNTWKLNRYLNKLDKQVEGEIKRAITKYFELNEKENATNQNLGDAMKAILV

SEQ ID NO: 782936 - protein, 152 aa, Homo sapiens
TTGAQREAWRKRSSSPTSPGHRAGEARPQAGLGPARAHPSSAVRSCPFPSLASTLLSGIPGQRPSHRGKRRVLAGRTGPIFGSSDRPRQELLRHQLPGAHRRASREDHHSPFYRWTNQGHLLLHHLSLGTVPGMPGRKAAVAQGEAEMEQEG

SEQ ID NO: 782937 - protein, 67 aa, Homo sapiens
GQPPGSHRGCCPSIRGSPSLQHWWGHLQALPAWSPALQLVRHPHKVPETTWSNHHFPHKQTKMQVFS

SEQ ID NO: 782938 - protein, 103 aa, Homo sapiens
MFEESYCICPVSSVNRVPLCFWEVKKNPEPSSDFPLGLGIMRRWLTSFIELSFTSNPSESLIDPIFLTQPLPWTSFLSPISLISLSHGSRGQKCEIKVSVEPR

SEQ ID NO: 782939 - protein, 35 aa, Homo sapiens
LLVVLVLMVVLVESMGAILGLTELVAGGIGEFGGG

SEQ ID NO: 782940 - protein, 35 aa, Homo sapiens
MAGGKEEQVTSYMDDSRQRKSSKYTGPEEGVAWLV

SEQ ID NO: 782941 - protein, 64 aa, Homo sapiens
MMSEGSGGELAGTVKDTKDLQSEVQAVGVTPRPMAGGCCWGTEHPAGSRPWMLIPAPLATIWGH

SEQ ID NO: 782942 - protein, 100 aa, Homo sapiens
VSMTTANVSWEPGYDGGYEQTFSVWMKRAQFGPHDWLSLPVPPGPSWLLVDTLEPETAYQFSVLAQNKLGTSAFSEVVTVNTLAFPITTPEMLVLVSPTR

SEQ ID NO: 782943 - protein, 67 aa, Homo sapiens
AAEKEMTSVVAEFGTGLVGSLELEEEQPELKMCGFIFRSPLNKDKAAAAGMDELIRLKCAPREEGQR

SEQ ID NO: 782944 - protein, 61 aa, Homo sapiens
EAFCPGLGEKECMCEAGIQWPWSGARAHRQHQARGGFKTRVLSLSHPTGTLDPSLLRPWNS

SEQ ID NO: 782945 - protein, 81 aa, Homo sapiens
SWSCSADEVMHFSDCKIQNGTSGICFIYTGEGRPSGEAFVELESADEAKLALKTEKPWDTDTLKYSSLIVLKWIGYRSTQV

SEQ ID NO: 782946 - protein, 37 aa, Homo sapiens
SHTCPCLRAQPRALERLPFSIPARPCQLLSGMDSHSL

SEQ ID NO: 782947 - protein, 45 aa, Homo sapiens
MTLLAPSPREAFSAWHHRWLGPWCVHLPLWLPFLIFYLIPKNRFP

SEQ ID NO: 782948 - protein, 66 aa, Homo sapiens
KEDEDAYKKQFSQYIKNSVTPDMMEEMYKKAHAAIRENPVYEKKPKKQKRRGGTIPKYPLLRRKIR

SEQ ID NO: 782949 - protein, 154 aa, Homo sapiens
KEDEDAYKKQFSQYIKNSVTPDMMEEMYKKAHAALNSLLSDIITRESFGTVRDRQASIHSSLQGTKNFIASGSSGKACIQIAGEGTWLTINAFHIVFITSHLHLAFIDLVHAKHIEKLAGQQQASTICCSIICQANLHTIFWQFVCIRRAEFEG

SEQ ID NO: 782950 - protein, 55 aa, Homo sapiens
EEEREARLWGAAGSQAGLLRSAWPQEWGRLVVSGLAGEVVGEIVLLGGWPPLSPH

SEQ ID NO: 782951 - protein, 96 aa, Homo sapiens
NRPYAGLQVFIHGKQLQLASGKRREGHNEIHSLKSERLATLSAEENPEQLESSYLVGRNGQQYNLHGISMAGDESHTFFFFIIFFGERLFRPCALG

SEQ ID NO: 782952 - protein, 91 aa, Homo sapiens
SSRDVSPSPACFISPAVLVVGTQKSEHIYLLAAGGHSAPSLGHAPLCMSVPIPQGYRPAPPTQGTPWSLLGDLQTQGRWGLDLPFLRCPRS

SEQ ID NO: 782953 - protein, 197 aa, Homo sapiens
EAVNTKNPSWVCVAVIADIVEDRLRVHFDNWDDSYDYWCDVNSPYVQPVGWCQENGRTLIAPQGYPNPENFSWTEYLEATQTNAVPAKVFKMRLPHGFLPNMKLEVVDKRNPRLIRVATIVDVDDQRVKVHFDGWDHKYDYWVEADSPDIHPIGWCDVTGHPLEVPQRTNDLKILPGQAVCPTPGCRGIGHIRGPRP

SEQ ID NO: 782954 - protein, 34 aa, Homo sapiens
KPPPPLSWPPQGALKGPGHAGAVDALLAPLWAPT

SEQ ID NO: 782955 - protein, 50 aa, Homo sapiens
GASALAPNSACLPTCRSLGQAHTASCISLDVFLDVPSSGKLASCSLAKSD

SEQ ID NO: 782956 - protein, 84 aa, Homo sapiens
QLMSSKTPGAGRAAGASFREPVNADSQVSLGVSDLVLGRALEVWILTNFLGYSAVQSISEALLQGRESADPLWPPSFSGRSHEH

SEQ ID NO: 782957 - protein, 68 aa, Homo sapiens
REGTHTSTRTAQMFKAAYCVTTKGKRPKWLSTDEWVSTVWPIRGGTGSAEGDLSTHWNMTRPRTGTRL

SEQ ID NO: 782958 - protein, 93 aa, Homo sapiens
ECSAWSGDTPGKPNIVLCAVMWPYSARNREALLLELPGQMGCVGSWHRQNLADHWLPVPAKALQTPETLMETQALGAPPNELGRILCFLPSGG

SEQ ID NO: 782959 - protein, 129 aa, Homo sapiens
FYLIINLYSKETSTVKSLIFSYLLCAPEHFPYLISPLNQELQNSTFCSSVLIFKLPVSLTTPSLPLGSQTFYEATGEIYLLHSNHSPLEPNHFWLPHKNDWGEGCLMDTTLPSDCLKEDYSVPLLCPRH

SEQ ID NO: 782960 - protein, 51 aa, Homo sapiens
GPHSTSFTHTSPPAPAWTPAISTLVASKARTYSAPKHTANTQLLNTQHPNT

SEQ ID NO: 782961 - protein, 109 aa, Homo sapiens
SEHTHLLHEGFPPSPLQLASPSQPINMFLSHASVKHKNQNASNICLPLAVSSFMLSFLRSCLYLLISHPPHTFTPQSRHFPDLNILNQHHLPALWEFSLNLFLSFSKTL

SEQ ID NO: 782962 - protein, 95 aa, Homo sapiens
QHSSSRPLLGGLEPSPQDTKRNETHAGVESRERSMHGVRTRGEARVPGTHQGRLLGGKRRSQALRHELRQKHKAWALRRLGGLKSWGRAPAREAG

SEQ ID NO: 782963 - protein, 102 aa, Homo sapiens
RRLWSSGIPNYLAMSESGELFTEQMPGFAEGHQLQGLCPQVRGLRLDYYTLGSTDVQLWEPGHLHHGNLSLGLKLAPALPLTHDETLCGAYSEPVSSSGKRG

SEQ ID NO: 782964 - protein, 120 aa, Homo sapiens
NAAEDPENLQGPCPRPATATPQGPWSLSGNAGHLREAGPQIPRVAGRGCCVWRGKGCCLNFQGNDVGTPGGRDALTPLHSRGHGEPIRLWPCGPSPFSDGLIVIFSHLLFATQRQSGCKR

SEQ ID NO: 782965 - protein, 118 aa, Homo sapiens
PERFQLLTSQLGDPADTDYTAVGCAITTISSNLTEMSKGVKLLAALMDDEVGSGEDLLRAARTLAGAVSDLLKAVQPTSGEPRQTVLTAAGSIGQASGDLLRQIGENETDERFQVRYL

SEQ ID NO: 782966 - protein, 99 aa, Homo sapiens
TGDGVGAEARPPKQPRRRGKIRRFPQGQGPAKPLPKDSPPRKVLPHGREAAGPSGLECPCGPPDLTPSSSVTCEWKKVSLPVLRRGISTMTREGADESF

SEQ ID NO: 782967 - protein, 91 aa, Homo sapiens
PRDHRRYFYVNELSGESQWEFPDGEEEEEESQAQENRDETLAKQTLKDKTGTDSNSTESSETSTVVYSDPGSDWLCNGEQNEASAFNSVRG

SEQ ID NO: 782968 - protein, 204 aa, Homo sapiens
IWRPSFSEGTDLFSFFRDVGLKILSNAKIKKPVDCSHRSPEYSTAMGGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLG

SEQ ID NO: 782969 - protein, 39 aa, Homo sapiens
GPQFVTTNVEKGTEALPHPSKTELLAVRINAHYFSRIKA

SEQ ID NO: 782970 - protein, 83 aa, Homo sapiens
EESGEAEHGVRGEESGEAEHGVRGEESGEAEHGVRGEESGEAETGSVGRRVVRLSMGCVEAEHRVRGEESGEDEHGVHGGGGQ

SEQ ID NO: 782971 - protein, 96 aa, Homo sapiens
GICPTLGLGALGRESSLQEASQRVTQNRSVVCTWLGIKLHVDELVNPTSRQTDMWGMSAAGAQTCGPEGQRSAPSSVQLTQELASVAKIALLPSVL

SEQ ID NO: 782972 - protein, 241 aa, Homo sapiens
PSADLEVQAGQVNVKLPEGPLPEGAGFKGHLPKVQMPSLKMPKVALKGPQMDVKGPKLDLKGPKAEVMAPDVEVSLPSVEVDVEAPGAKLDSVRLEGDLSLADKDVTAKDSKFKMPKFKMPSFGVSAPGKSIEASVDVSAPKVEAEVSLPSMQGDLKTTDLCIPLPSADLVVQAGQVDMKLPEGQVPEGAGLKGHLPKVDMPSFKMPKVDLKGPQTDVKGAKLDLKGPKAEVTAPDVEVSL

SEQ ID NO: 782973 - protein, 101 aa, Homo sapiens
TIKIIEENLGNTVLLGKEFVAKSLKAIATKTKIDKCDLIKLKGFCTAKINSRWVKDLNVKPKTIKSLEDIRGNTILDIGPGKDFTTKMPKAIATKTKIGKW

SEQ ID NO: 782974 - protein, 533 aa, Homo sapiens
GAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKFLAMVFQDLLTNKDDYLRASRALLREIIKQTKHEINFQAFCLGLMQERKEPQYLEMEFKERFVVHITDVLAVSMMLGITAQVKEAGIAWDKGEKRNLEVLRSFQNQIAAIQRDAVWWLHTVVPSISKLAPKDYVHCLHKVLFTEQPETYYKWDNWPPESDRNFFLRLCSEVPILEDTLMRILVIGLSRELPLGPADAMELADHLVKRAAAVQADDVEVLKVGRTQLIDAVLNLCTYHHPENIQLPPGLPASEPSPFFTLLLEGLGPPAWSFAAFNPENIGLAAWEEYPTLKMLMEMVMTNNYSYPPCTLTDEETRTEMLNRELQTAQREKQE

SEQ ID NO: 782975 - protein, 243 aa, Homo sapiens
GAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKMNCNTHGSEDMDVISHLIKIRLKPKVLLNHFMLCIRCVASRG

SEQ ID NO: 782976 - protein, 82 aa, Homo sapiens
HALTARGYRLCNPYDSELPSVGSPSDYDLESYFTEKTEAIKRDFQNPPQSNVIHFNNVPFQPKLKTDFITTLKHKKLNAIWY

SEQ ID NO: 782977 - protein, 65 aa, Homo sapiens
CHAHKSLDFQVSDHTQSLDVQFMPTPGGLSCFEAEQPQDTKDAVQEDCLISESLLPFQLHPQTFH

SEQ ID NO: 782978 - protein, 46 aa, Homo sapiens
LNTIKSRAGQLFPHTQGGGMDPQDHQHLRGHAPSPATPGTNWDITE

SEQ ID NO: 782979 - protein, 76 aa, Homo sapiens
CGGHASMESCTNRPIKPHIDSVWTFEKVADAMKQMQEQTVQVMTAELDLSNFISHSLNNPKLKNEYSTMTILISFQ

SEQ ID NO: 782980 - protein, 167 aa, Homo sapiens
QGQESCVWGPSFSQRLRPCTLLAPYLGSQRRSELAEVTQSGGIWDLNPGVLGPMACVHPFSQGLPDTGSLPLPSAEPLGTRLHRPGLRVSLGFAATHNLYSMNDCAQKILPVLCGLTVDPEKSVRDQAFKAIRSFLSKLESVSEDPTQLEEVEKDVHAASSPGMGGA

SEQ ID NO: 782981 - protein, 38 aa, Homo sapiens
MAGATQSSQVWLPLSQCSDWDSKAGRCSLSQQTSPSVG

SEQ ID NO: 782982 - protein, 720 aa, Homo sapiens
AAKVDPAGSPSVPRPRPAMLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVRGFRREEQIFSNVMKFPFASILEL

SEQ ID NO: 782983 - protein, 728 aa, Homo sapiens
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGQGMSREL

SEQ ID NO: 782984 - protein, 217 aa, Homo sapiens
LFDWSPTRRKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGQGMSREL

SEQ ID NO: 782985 - protein, 960 aa, Homo sapiens
AAKVDPAGSPSVPRPRPAMLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGQGMSREL

SEQ ID NO: 782986 - protein, 488 aa, Homo sapiens
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVRGFRREEQIFSNVMKFPFASILEL

SEQ ID NO: 782987 - protein, 647 aa, Homo sapiens
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLESGILIQELTQQSVAVAGR

SEQ ID NO: 782988 - protein, 728 aa, Homo sapiens; identical to SEQ ID NO: 782983

SEQ ID NO: 782989 - protein, 960 aa, Homo sapiens; identical to SEQ ID NO: 782985

SEQ ID NO: 782990 - protein, 997 aa, Homo sapiens
AAKVDPAGSPSVPRPRPAMLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQDIGFSLAVQNWVPKGYLDISCVTLQVQCNWKGKAKAKTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGQGMSREL

SEQ ID NO: 782991 - protein, 960 aa, Homo sapiens; identical to SEQ ID NO: 782985

SEQ ID NO: 782992 - protein, 530 aa, Homo sapiens
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGKFYLPLQHLGKDQVGTASPSVLQMDVQ

SEQ ID NO: 782993 - protein, 111 aa, Homo sapiens
ISWSFWKQHGGEMGEFPEPLCLMFDRGVACLFGHHPFNPLRDGEQAAGQVQEPKWACVTVCPFSLAVHGWLECWPAQWTLCLSVRAECQCDSSLYPKLLSSILGEAGHTCT

SEQ ID NO: 782994 - protein, 96 aa, Homo sapiens
FVCCPLPEGSNNVDSADPEEDDSDVWWGADTDYADGSEDKVVEDKALSSTLYTSKIDKATLFILSKINLLLLVLLGVSCLRYPGTCKLKKVKVILI

SEQ ID NO: 782995 - protein, 35 aa, Homo sapiens
MEGATEELRNTQLARGPERADASSETTESDGDLTL

SEQ ID NO: 782996 - protein, 107 aa, Homo sapiens
CNWFSIPERRPSDGRPPEVTHLKGLRRAHPQGSRTWNRRVCTRHPMQGISSSSNSPGQMQRWMCGIFKGSLAAEVPWQNLFLLTPDILASTSVPESVINPQELISTF

SEQ ID NO: 782997 - protein, 96 aa, Homo sapiens
SEVWLSFGGELVTSSGLVCNMSVVVTGLEVRSEVTGRGEEEIVTGNVEEMGGGEVVAGKDSREGRELGFSREGELCHDISPGPLLMRVVISECGNL

SEQ ID NO: 782998 - protein, 76 aa, Homo sapiens
MGIRGGLWVVPILFLGAGVKSKPVVGKLAPSLVATLLGLGVKLPPALGEECEGREAAVLFIHRSWRRVMAAWRKSS

SEQ ID NO: 782999 - protein, 86 aa, Homo sapiens
QRRRSSRSSSRGKREEEEEEEEEEEEEEEEEEEEEEEEEEEEEEEEEEEEEEEEEEEEEEKRRRRRQIIHVSFYYCDHNSIENCLV

SEQ ID NO: 783000 - protein, 110 aa, Homo sapiens
MGSLIPVPSCHSLSTGHPHLPITSHPSHGQPHPCPQLSCLHRGCSLAAQVHVKFLTLKPPELASPLLLHVLLSPPFTASFPQKVTSTVHLVSRPPPAPQPAADFLSPYPN

SEQ ID NO: 783001 - protein, 1270 aa, Homo sapiens
RDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLNLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 783002 - protein, 1006 aa, Homo sapiens
RDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLNLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKGDSLAMHCLVSCPRVVPSVAGFLWRSSTTYLGKVLGTDFEWLHLQSQPDSRGVSSLGSV

SEQ ID NO: 783003 - protein, 1006 aa, Homo sapiens; identical to SEQ ID NO: 783002

SEQ ID NO: 783004 - protein, 73 aa, Homo sapiens
HYYTHYSSAIIVASYLVRMPPFTQAFCALQVSCCHSLYTHTHTHTHTYACITRLRPVLEQRQDASAKNSVISQ

SEQ ID NO: 783005 - protein, 44 aa, Homo sapiens
FCWFGCLSASLQTQALTLTRPPAQLAMWPYSVISLEFNLDSEDP

SEQ ID NO: 783006 - protein, 55 aa, Homo sapiens
TPVASPGITDKSHRVRPPVPFSKQGTRNPESQLEFQIPSFLYVIHLTKLRVSEYL

SEQ ID NO: 783007 - protein, 121 aa, Homo sapiens
MSHQCTHFADEERCLSTGMASLACVGQCLYRSPASTHLFQSIHIFHQQNEFTRNLSSNWYKDYMTWHVMTHTQRRSFFQHAGRGDPIHGLGGGFPHCSVRSPSSSGSRSDYLRFADEEAEP

SEQ ID NO: 783008 - protein, 132 aa, Homo sapiens
EVNQVHRKRLQLHLPSCRRLSRLHTLTLFGLTLPDKGDSWPRLQSESTSFLQAQKSQELEHLPGDRDLEGSPRPHFLRPPLYQERPDNSIILSFLEANVLLLHFPEGPALTSEPLLGAQPPLFPPQEEAGGW

SEQ ID NO: 783009 - protein, 135 aa, Homo sapiens [sequence omitted]

SEQ ID NO: 783010 - protein, 108 aa, Homo sapiens
WHNLSSPQPPPLGFKRFCCLSLPSSWDYRHVPPRMSNFVFLVETGFLHVGQAGLELPTSGDPPALASQSAGITGVSHRARPKRALSSFMGQGPAQTIPVPSYNSGSTG

SEQ ID NO: 783011 - protein, 103 aa, Homo sapiens
LEDETQIILIQCEKVYGCVEEGFLEFLERMILSSVLTKEELLRLKVDEKGLLIKRNKTGLRGVKQILCMVNYNELGVFCSPKVQGIKRQKMILEYRQRILHLS

SEQ ID NO: 783012 - protein, 84 aa, Homo sapiens
CRTCKTRWTPECSYAILCHAQSSPASSLLIDWVLFSHLHLLHPPSNISYYIQTSLWLRNSPPDTGILTMWDDYYCMTPSIDAGL

SEQ ID NO: 783013 - protein, 31 aa, Homo sapiens
EDCLSLVVVKYDWATVVQPGQQSMNLMNLFP

SEQ ID NO: 783014 - protein, 136 aa, Homo sapiens
GEARSVLHGGRRESKGEETHTYQTTRSHENSVMRTASGGLGQGVCPHDSVTFHQATLPTHGDYNSSLDLGEDTESNRINIFKMRRLNKMVSKDFSSAVRSILFSFSAYKGARAAVYTFLGCVLHNSRGACHMITQM

SEQ ID NO: 783015 - protein, 142 aa, Homo sapiens
RCQCHCVSVLPSETAGFPRGLCTHLPIQAERNTVEHFSVTPGHPGNSHLCTLDNLAAQSFWFCFFSFPSSWAVDHHLSVVLGLPLSVLEAVPRGEWRICCLVQILTLVCSIYRSFCQGLSPSETPCIHRQSGDNQTCLIRGT

SEQ ID NO: 783016 - protein, 58 aa, Homo sapiens
EHARILRFFTTLFFFCIIPACMIPSFIESLLKCHFLHVAFLDTLFKIVVLLPHIHDPT

SEQ ID NO: 783017 - protein, 70 aa, Homo sapiens
TSLCSPPLILAGKAGLPEKRGGFAHLDPKLIESGVKTKGTQTGVSVLFYAHSRRSQDWLLPAGSAVLRVR

SEQ ID NO: 783018 - protein, 70 aa, Homo sapiens; identical to SEQ ID NO: 783017

SEQ ID NO: 783019 - protein, 84 aa, Homo sapiens
TVRRSSERRNRLNRDYGFSVPQCTTVSKSQTYQPLLLLLSRDEAPDSSGGGHGAAHCPAQPHQPRPWQAHPFLLLGRHSSAGTF

SEQ ID NO: 783020 - protein, 91 aa, Homo sapiens
SRSEYVVLKKDVALLHSKVELWQGGCLNDEITSSGPTGDGLTELQSQISDTSVVLSMDNSRSLDLDCIIAEIKAQYEEMAKCSRAEAEAWY

SEQ ID NO: 783021 - protein, 76 aa, Homo sapiens
IVSGIGGLLVSLTSRMKPRTLTTYHGGALQGLQYKWLKHQEKLPVFLARGTRITCPTKLQSVRRLLDQKQSEKGIL

SEQ ID NO: 783022 - protein, 40 aa, Homo sapiens
MPGAPASTIEMTTDVPRRGLVLRGKLLSTNHGVLPLTPAP

SEQ ID NO: 783023 - protein, 55 aa, Homo sapiens
GAGTPSRKALSITAEAEPVRTRQGHGHDYGERPSPVVSLQFPAPLQTLQGPQRDL

SEQ ID NO: 783024 - protein, 89 aa, Homo sapiens
VVERRQAGRSTWLKVGEAHADSTTFTDAHVEPGRKYTFRVRAVTSEGAGEAWSLRRYWWLLRLSPSPFRASHPVGLQPGHHTDMDSTSG

SEQ ID NO: 783025 - protein, 191 aa, Homo sapiens
QSAQSGTTVTCCLSPDLAWTCEMPAQSAERPMRCSGVTGFVSGQQPSPILGEPTASQPRHSRDGAWTQQRWSMERSNSRVPPPFLPPIPGLTPGRPDLCSPWSFHHLFSGQSDQEPTHPEGKNDQGALPGPKTCQASSSQRPSSAATVCPSSMFSSTEEPSTGQEASTSACFLPVSLQFSSCKPLKGLETP

SEQ ID NO: 783026 - protein, 55 aa, Homo sapiens
KTNRTVRGNRQICNISLLEFHRTSRQSIKKNPGDLNKNISCVWSCQEAGTKTGFN

SEQ ID NO: 783027 - protein, 70 aa, Homo sapiens
FYHVRARVTSSAGVNTKGMSLTGFAVLKTRGKCKQWSAVATRRHDAPNSSSVMGKKRKKEPLYKEELETY

SEQ ID NO: 783028 - protein, 79 aa, Homo sapiens
GARWPLLPAYTGNAHLRLSAEMQGLRRGAGDSSETLGRIPSPPAMEWKTHRDLIAHQQRPRRRRRASHSPANAHESHVA

SEQ ID NO: 783029 - protein, 48 aa, Homo sapiens
AAGITGLSYHEPRNFMRISLLLDGFWSKTTWVRLLAPLLTSCVTLRTL

SEQ ID NO: 783030 - protein, 56 aa, Homo sapiens
MAHQEHRIRNLSVTYRSTRSLPGASCRVRPARFPGRTSQGRKTASSIQEPFPFENH

SEQ ID NO: 783031 - protein, 80 aa, Homo sapiens
RMRNWEGLDIITITEVGVGGLSVGGPQWVHGTAVCKRACPHSGLGSSQLWHFRTEHVTVQGEAAIVICLNRQGLPRMRNW

SEQ ID NO: 783032 - protein, 101 aa, Homo sapiens
RGCNELRSCHCMPAWVTEQDPASKNKKQFVNYGTFGKLTEASTQNSVFVGYIYFSSPRSPKGINKELFSISSEQYVYGDRRMGRWSKLGRIKKYARGLLSM

SEQ ID NO: 783033 - protein, 112 aa, Homo sapiens
HPFPTPVFILEMGMDKASMVSLVAQRGQGSYCCETAVVGRSWYKKANPEAWDCSAENKWARTWGRGGSGEAPRQTAQRGCWAVGPRAPAPVTVLGLWRCLHPASWLWAGSEW

SEQ ID NO: 783034 - protein, 84 aa, Homo sapiens
GRTSYNRARRCHLDDGWTSRDRDMIGSEAPRQYIKISAILLTRASSNIDARKGQGMNHLKRTEYFINEHTMCYAVMSKRFGKEL

SEQ ID NO: 783035 - protein, 102 aa, Homo sapiens
MVRHGLVKVPPVVIGTAQVAISPGLFSLVPQVLGYLQMLLMALHSILKVTHGNIHSSHVAKFSGFRKFIFGLLGKKNTLFVTGQCIGVVSNGCVHVAQTAQG

SEQ ID NO: 783036 - protein, 101 aa, Homo sapiens
SLAFVLAQQPLRPSQHCTSTLHVWLGTPNKTPWTGGLNDRNLISHRSGGWKSKTKVSAGLVSCEASFLGSQMVIFLLCPHMIVPESVCLSSSDKDTSPIGL

SEQ ID NO: 783037 - protein, 125 aa, Homo sapiens
TCLWMAEVCPAASSCIHHPCPHLRLGIHSQQAAQLAQSWPESGRWRSLSAFSWKDPVGGRSGPGAGEGVCSQSLVSLPGSRNVHGIWFGCASPWEAVLGQVLPVLAQGLSISMEWTPSLHTRISV

SEQ ID NO: 783038 - protein, 105 aa, Homo sapiens
CWHFGILERDGGNAGVLVAEGPHWEPPRAPSLALRRLLLGRAACHLPPHDFPFNYCSLPVLAQLVINSFILMCEWLSVPSNLAGRGVNLMEGILGGLLSSPISPF

SEQ ID NO: 783039 - protein, 117 aa, Homo sapiens
GAHSDLVGASSDDWGIPASNMTKKKRENLGVALEIDGLEEKLSQCRRDLEAVNSRLHSRELSPEARRSLEKEKNSLMNKASNYEKELKFLRQENRKNMLLSVAIFILLTLVYAYWTM

SEQ ID NO: 783040 - protein, 117 aa, Homo sapiens; identical to SEQ ID NO: 783039

SEQ ID NO: 783041 - protein, 165 aa, Homo sapiens
GAHSDLVGASSDDWGIPASNMTKKKRENLGVALEIDGLEEKLSQCRRDLEAVNSRLHSRELSPEARRSLEKEKNSLMNKASNYEKELKFLRQENRKNMLLSVAIFILLTLVYAYWTMSPPPSPLHAGAHPHGHCEQQAGGLSFQVSCENSISPLTGLIEHRLIGS

SEQ ID NO: 783042 - protein, 117 aa, Homo sapiens; identical to SEQ ID NO: 783039

SEQ ID NO: 783043 - protein, 138 aa, Homo sapiens
GAHSDLVGASSDDWGIPASNMTKKKRENLGVALEIDGLEEKLSQCRRDLEAVNSRLHSRELSPEAREGTEVSSAREPEEHAALCGHLYPPDARLCLLDHVSLALPHNQHRLPLGPLVRIKQALQASIGPRCWGVPLPT

SEQ ID NO: 783044 - protein, 61 aa, Homo sapiens
MGREGTQNIQHHLEKEEVGLTLPNFKTYYKGKVNETGWYWHKDRHIDQWNKNESSEINPPT

SEQ ID NO: 783045 - protein, 103 aa, Homo sapiens [sequence omitted]

SEQ ID NO: 783046 - protein, 262 aa, Homo sapiens
RQWLLGEWACKLYTGFVFLTFSTSNCLLVLISVDRCISVLYPVWALNHRTEQRASWLAFGVWLLAAALCSAHLKFRTTRKWNGCMQCYLQFNLENETAQMWTQEVFGRQMAVIMAHFLLGFLGPLAIIGTCAHLIRAKLLREGWVHANRPKRLLLVLVSAFICWFPFNVMLLVHLWRRVMLKEFYHPQMLLILQASFALGCVNNCLNPFLYVFVGRDFQEKFFQSLTSALARAFGEEEFLSPVPVATPPGNDGRLQLEAGSR

SEQ ID NO: 783047 - protein, 57 aa, Homo sapiens
GLIEAVATGLRQSDSSSVHHEAKKIQCRMLDSKTVEKIKAVKGNRVLAACRVLTVLY

SEQ ID NO: 783048 - protein, 53 aa, Homo sapiens
GQKTCQGSFLGHFLNVGSESACSYMKASPDQTGLQPSLSPGLRLEGILLEGIF

SEQ ID NO: 783049 - protein, 34 aa, Homo sapiens
MRKVGAAEALTSKRGKVHMWMVSSLRGGQQTSPT

SEQ ID NO: 783050 - protein, 46 aa, Homo sapiens
MGAGIPKELKVGAASCWAAPSSIQHFCGKWRMASLWANPSSHRVLT

SEQ ID NO: 783051 - protein, 112 aa, Homo sapiens
SDLEIHITHFPHCILKHNSIPGTFRISSSQASELEPNPRSHTLLHPNTAMTCDLAVQRPCQCLQAHSTKSLKGRGRKGLTALRARIRKALRSQIRVKQLVPRAVMTPGTPRH

SEQ ID NO: 783052 - protein, 101 aa, Homo sapiens
IWFPLGGGHYRGIRCGHQTSSSYLGMPQDTWAQHSFWHSAPLPPAGPVPLPRALSPKNGSRKKHSSVSAFPPHLTLLRPVPSISKSRLLYVGSYSPPPLHS

SEQ ID NO: 783053 - protein, 84 aa, Homo sapiens
GQEIRGAGTTGDPPRRGPGHSTEEAQGSLLSPLLHLLTSEGQKLHPQIRLTPLVFAHREGVKLDCAYAWFWVCSWFLLVGSWSR

SEQ ID NO: 783054 - protein, 159 aa, Homo sapiens [sequence omitted]

SEQ ID NO: 783055 - protein, 124 aa, Homo sapiens
VRWCVAPSPRLHVSGAVREASVVTSASFPSEGCPGPAEPISPLWLQPDPASKHRNLGSFCQGRREAEMQEGGVGKGDKRQKNRERDRGETEKAQTDIWTDQKWEDKTVTETAIAKLEAFSGPQL

SEQ ID NO: 783056 - protein, 97 aa, Homo sapiens
PLKGPAGNINKWNEWGSSDEYSIFHVWGADITELLPCGNLSPVVPGLLSYSKRSKNSSLCYSFQFLNIGSILKICSPKKTVLWADFGLQAPVSHLCL

SEQ ID NO: 783057 - protein, 93 aa, Homo sapiens
TCPCSWSTCPYLPLTGVSAGIIFCLNCWAPPAALRHPRAATSRAFTAQAPGAVIRGQQGHWVAKGTRAPRCAAHLGQGGPDSGFQNYSHCPAH

SEQ ID NO: 783058 - protein, 52 aa, Homo sapiens
MAGGKQLEVKVVSQTTGLVDGGWPLFRGHWEDRTTKDTLCEEGTLAYSWKQR

SEQ ID NO: 783059 - protein, 84 aa, Homo sapiens
PGDNRTLLLLLKPVWEHPHPGTPRQPGSPLTRWLKEQVEQEVGASDPGSPGGQAWWPMSMESPTRQRPPAMPPGYQATHGRGWG

SEQ ID NO: 783060 - protein, 75 aa, Homo sapiens
SSDWRLSEERSREELWSDGRTGQCNDCEGPNNQDQEVLLCGEHIVSLNGEWDRGVWGYRVDECPLPAAGLCLSYH

SEQ ID NO: 783061 - protein, 91 aa, Homo sapiens
GSPSTAWFTSWMNSCSFITRVAAWPSAFPDAASLEPALKAALIHSFTSKSSARNLEKSMAELPQAWRPELKSWLRAATGMQKRASLREHRG

SEQ ID NO: 783062 - protein, 109 aa, Homo sapiens
RNSHDAYDEERKTNPSAVVAAQSNWEKVAPESLGFQEGTHELCYNTACALIDHGQLNQAMNILQKAEGLCHHSLSEDTDETEEDPQAGLAITYGQMAYILQLQGQTEEA

SEQ ID NO: 783063 - protein, 96 aa, Homo sapiens
SCSLGMHTGMVGSGYKPLPSLPTSYVSVNALSSVSKLHPNPLHLYLLSTVLVLATITTTNHIMCPLCKPLLTQQPESSFRSRPCLKCFGGFLFHIG

SEQ ID NO: 783064 - protein, 242 aa, Homo sapiens
SPTEKLACSLPLEGWSPALKTQGKLNTRPGKVIFFSESGCQGSGREVWGDIVDASGWAPVASIRVVRGCWVLYEEPEFRGQKLVLPEGDMELRTPGTKWSPQGIGSLRRVVWDYSTPEISLFSEEGLKGEQVKLTEALKNSQGLEKPLQVASATVSAGLWLLYPKPLFEDTPYILEPGEYPTSEAWGTSDPSVGSLKPRDWAAKCGEARGAQAVVYEAQAFRAAAGSEPRIYNFRAEDSRAP

SEQ ID NO: 783065 - protein, 105 aa, Homo sapiens
DAKCHNYIPHCSGELLGSSNPPASASHVAGSPGPGTGQAAFCRREEGGPTEGQVFLCSQRPAGGLDPRDTPIHEYPKGILSWGLEEGQSLHQGKGAEGPCPLLPF

SEQ ID NO: 783066 - protein, 668 aa, Homo sapiens
NEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCIACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEGQNLDFCQNLEVISAVCLGISSTEN

SEQ ID NO: 783067 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 783068 - protein, 158 aa, Homo sapiens
LTVPLLFVYFFPFCAETHLSSTNTRMRNWNFSAGSLRNYDLVLIPSDPIALTLSDASTAPCTGRCGVGRASACGTALPTGKEEDMAGTWPDSRCAPSCRVFHMAGLPPVPAHILGPCDLELHKVKSVQIQMVCGSNFLPQEALHNLALHASSEPTLPV

SEQ ID NO: 783069 - protein, 130 aa, Homo sapiens
RRVAGKLVVVRCGGSRVCPAVAYPTPPCPRRAAMSSSSLCRCLAGREHQASSGLPKAWAPGGATVGICLRLSVSRRQVTAWPLQSLQDHHEARRTSWSSPYRLPGLTLGSRVLGAASSGTSGPGSSSLRI

SEQ ID NO: 783070 - protein, 101 aa, Homo sapiens
MVRQGWWGLRSPPSTVLYGQACLGRGPRLADWGVRWALGERPPVSPLPRPLLVRGLFELTSRLTPKSSALVLVVNIGCMGLLSAKRPCSVRLFAHLHGPAA

SEQ ID NO: 783071 - protein, 98 aa, Homo sapiens
MAHAGGTLAWNLRAPEAELEAWYWGILGMRVGGWVGARREERTGPTWKTSQVWVRSYKHERARGILIVLSGAGEKRAGQEAPTFLSTILQSSFSLQMG

SEQ ID NO: 783072 - protein, 46 aa, Homo sapiens
DTRIHTQTHARAHTRQLTLAKGCELKHYRTQTPTHRHWLESAHNLF

SEQ ID NO: 783073 - protein, 208 aa, Homo sapiens
RGRGGRRGTRALAGLEGLNIAGCSGVPRPASPKSYTDADRGGVLPRPRFTSRAPNAGSSDVRFPVRLLPDTRRLSPALAGRAPCKVGNAEPRTRSRRLRLAQGGSPGGARGRGTRRGPRPRRGARATQNKEKKRTKKEKKRKKKENKKKKTQKGNEKQTTQKKSNKKKQKKKKKRKKKPTKDKNNKQTQKRKNRYKKKQIEKETTEQK

SEQ ID NO: 783074 - protein, 157 aa, Homo sapiens
GVGTENSESMEISSHSPSSFGNSFLFRKDNSQRPSHIITQNLDAKPCAPMELGRIQTFVRSTNIYVYIKYVLFSFFSLETGSPLSPRLEYSDAVMAHCSLNLPGSRNPPTSASQVAGSVVVHHHTWLIFGFFFVCLFVFETESRTFIQARLQWRDLG

SEQ ID NO: 783075 - protein, 68 aa, Homo sapiens
WSQVSVDSGEEVGKTQPAESLSHLPAGGPHTPDGQNAPQTEESAAHPPDVSKAEICFLGLATIFIEQF

SEQ ID NO: 783076 - protein, 111 aa, Homo sapiens
MPPPSQHLPPNYRKAHRARYHLMFTWPTKSGHAKLGQRNLLQDGSFHCYGPASMVHQKGTPLRCPPTLLDVAKNKRTRFLYFWHPQLPVSFQILRNYPSLKGSSFSLVPTA

SEQ ID NO: 783077 - protein, 152 aa, Homo sapiens
GFHIQGGVRPAEARKPGSPPPPPGGYVPIILVVGLQLNVELGEVGDGGEHDRHTLTGLIVELIIAPLAGQEVSGHVLGQDVVQQPPVVGLQLLHLLFLLCGLRERDCKSPRCQCEPRCRPLHLLLSVAWRKSTSMNSLSTSANSLSTSTNSL

SEQ ID NO: 783078 - protein, 129 aa, Homo sapiens
MSPWAPGDGDNKGGHSPAEQATGICPHPQLHFREHQGSYPRKTLRTTAVFLRAKEAGFPAWVLHEGTSRNKQRKENDRTKTWRPRGWNSITAGEGENHLHIYRGQVPGPLCGAWCHVRMQTLGHGSLKG

SEQ ID NO: 783079 - protein, 196 aa, Homo sapiens
YGGEPTPLFRPEFSVAPDCPTCQNPGGPAPQTKCVKKIFLGALTAPKKVFCLFCFIIFFGDANYFIAGRWGCREMETTRGATPLLSQATGICPHPQLHFREHQGSYPRKTLRTTAVFLRAKEAGFPAWVLHEGTSRNKQRKENDRTKTWRPRGWNSITAGEGENHLHIYRGQVPGPLCGAWCHVRMQTLGHGSLKG

SEQ ID NO: 783080 - protein, 77 aa, Homo sapiens
GAPRTLGFTWLLCFAWAADFWRSPFFLLSPDAEHTQSPWGNRPSSATPWSLLLFPSLTLCPASPSLWRLLELVRSPA

SEQ ID NO: 783081 - protein, 92 aa, Homo sapiens
RPACTPSTLLTLQAHPLPRLLRAAWQPSSRLAGQPSQYNCPLMSTRVPAPALSTPGQRYSPLPKCTVSMGIIIPQPALLSPPPASLSPCQHD

SEQ ID NO: 783082 - protein, 143 aa, Homo sapiens
VLAFWSEHAHYHLRGLEATHHHHGGRGVGGIIGLQSRHTSIRQTQNCSSRRRRHRCMKRTHFPLERSKYQRGITARQGPVIASWEQSSFDIMSNFLLKQILEDFTEAAVDEDDEDEEEGEEWQLNRRNTSNSGTSHLKHHSTS

SEQ ID NO: 783083 - protein, 107 aa, Homo sapiens
EYGSEALERMFLSFPTTKTYFPHFDLGHGSAQFKGHGKKVADALTNSVAHVDDMPYASVRQLSDMHAHKLRVDPVNFKLLSHCPRCFCPYTEDAGDATALAIHPMPL

SEQ ID NO: 783084 - protein, 105 aa, Homo sapiens
CQSMLLATTCTPTWKLTPAFFKGSSLGAETVPHESSRQKRPREGDWVQTQNLGPILSLWARCAFRKSFGVRLLPTLLPAPPSLLPSQRSHKCDLHHIPSQSSKHQ

SEQ ID NO: 783085 - protein, 81 aa, Homo sapiens
VALQLVRAREALAAEEPVAHEGTVAAVPAQVRLQVRRLGVGFPAARDVAVVQMLLLAPIGPTWSPQSLRLQTVGAATDGLA

SEQ ID NO: 783086 - protein, 302 aa, Homo sapiens
LRTLLQAALSTDPLDAGVDYSGYSPMHWASYTGHEDCLELLLEHSPFSYLEGNPFTPLHCAVINNQDSTTEMLLGALGAKIVNSRDAKGRTPLHAAAFADNVSGLRMLLQHQAEVNATDHTGRTALMTAAENGQTAAVEFLLYRGKADLTVLDENKNTALHLACSKGHEKCALMILAETQDLGLINATNSALQMPLHIAARNGLASVVQALLSHGATVLAVDEEGHTPALACAPNKDVADCLALILSTMKPFPPKDAVSPFSFSLLKNCSIAAAKTVGGCGALPHGASCPYSQERPGAIGLD

SEQ ID NO: 783087 - protein, 102 aa, Homo sapiens
MCSAVLGTEVVLTSGCCYCVSIVTVGGGQVESRKALSEALVYANPALLDVLCGPRRVSPPFWTPSSPCCLRHMMEMVVLGTTLRPGRMESLPRLCLCKVPGL

SEQ ID NO: 783088 - protein, 75 aa, Homo sapiens
REPLTLREPLTLREPLTLREPLTLRHPLTLREHFPLDLLGPNCRQSQDTRSGQQNQANLNFSAVMPSPKQRLQAP

SEQ ID NO: 783089 - protein, 81 aa, Homo sapiens
TVSLTLGEDESPEGNSNSVQVIEDNNVKETLISVMHKYAVIMAEDTRADAESHFVNGLDYLITLPYCGGRIVKKNAFETVS

SEQ ID NO: 783090 - protein, 74 aa, Homo sapiens
ETRMYSLVNKRQKGRLEVRDLGKRLLAGSTVDLEVEVVRVSGCCQMVREQTSIYQQLHHALRKSHRLNLQNSQQ

SEQ ID NO: 783091 - protein, 38 aa, Homo sapiens
MMRGRHSLNLWGLVDGRGANTPVNLSSIQCFGAATRFR

SEQ ID NO: 783092 - protein, 61 aa, Homo sapiens
MRLDPQLFLDLAYRVLGKLLQPGACHRLQPASLKSEHQGNDPDLVIVPTDGPAKASCANGP

SEQ ID NO: 783093 - protein, 114 aa, Homo sapiens
MPSSHLEDLFNADTGPYPQGQPRARHKGLQLNRSWSNRDKGDSFLQGQEEICCYPVYPEFHLQPLVVSEKLVRVRCFIYETMISQHLTTLSVSQKLWAAGYTWVLCLLAYLERS

SEQ ID NO: 783094 - protein, 60 aa, Homo sapiens
MEGRTRLRLGHAVCPGLQLRLWLKGLGSQDLTGRDSLYRTLVPQDFRNKPFHPYFGEIPF

SEQ ID NO: 783095 - protein, 154 aa, Homo sapiens
MEIAARLKGTYWVGDIYKRVLKIFQNGKDFGRTKRNYRIIAYIDTIEWEAIISLKGNDQAVPAEIEVPAEGYEGIMAQVAVSTLPIEDEESMEDEESVEDEESVEDESAESRMLVTLLISALESTFWRPQVQNQGVGQKCCSLCRLLGRILAFF

SEQ ID NO: 783096 - protein, 104 aa, Homo sapiens
TPCPQVAGTTAMCHHAWLILFCYVLWTWALHVFWPSVALSCPYLSPVSTSASQSAEMTGVSHCAQPVFVFDNLVISGIFTDMCNHHDSQLVKHFDDLKKKPLCL

SEQ ID NO: 783097 - protein, 117 aa, Homo sapiens
EHSPKTQKYTARNKHFSLQMEAKSLEYKSSRLSPRSQPRHLEFFVLHEQGLTVHHSVIPFSFLTNYSCTISEAETHEFSVFVLHTPSPVYRDMKMHSERSTGTAWSHGISVCFCAYL

SEQ ID NO: 783098 - protein, 42 aa, Homo sapiens
MLMLFVFGVLLHEVSLSGQNEAPPNTHSIPGEPLYNYASIRL

SEQ ID NO: 783099 - protein, 90 aa, Homo sapiens
AASNWLPVQLVQSRGEECGISWLAESSGFHLYSMSDASFCSSCPWTSDSRFFATGLSDLTSRLPGVCQGFGHRLKAALLASLLLRLLDLY

SEQ ID NO: 783100 - protein, 125 aa, Homo sapiens
RGASAGGRNQRMLLRLPSSSSGRYAQPFFGDLIMEKGKKEHCCVKAAQQETGEGEVTCSKRQTQVWVNLEENLGILAPWIPEKSVCPRQCGFLLHKQLFYYSHSLAPARLLQHLPLENTVEEKGS

SEQ ID NO: 783101 - protein, 107 aa, Homo sapiens
PSSVPSSGHALPFYAEAQPPPPSPFARQPHARGSRHAHPAHTTPTRLAQGQVRGLPSPSGCLLLLSSALLGRGGPHTAPPPEGRGWPQATEVTFICSQSKATANRSG

SEQ ID NO: 783102 - protein, 156 aa, Homo sapiens
VEGPTPQGVWDVPLMPLTAPSIQPSFPLAEEESEIQALERFFRGHMAAGLSFRTHAASRKRGPGASADTVGVPLWGPGPLTLRCWKEASSFLVPSNIYFPCEKPSVSVSLGLFTCVVEGLRKDQEIQGKLSKRRVRTAASCPPSVSTEPFSVPLQK

SEQ ID NO: 783103 - protein, 113 aa, Homo sapiens [sequence omitted]

SEQ ID NO: 783104 - protein, 113 aa, Homo sapiens [sequence omitted]

SEQ ID NO: 783105 - protein, 181 aa, Homo sapiens
MKRRRRRDILRVQLVRIFELLADAGVISHSASGGLDNETHFLNNTLLEYVDLTRQLLEAENEKDSDTLKDIRCHFSALVANIIQNVPVHQRRSIFPQQSLRHSLFMLFSHWAGPFSIMFTPLDRYSDRNMQINRHQYCALKAMSAVLCCGPVADNVGLSSDGYLYKWLDNILDSLDKKVIM

SEQ ID NO: 783106 - protein, 181 aa, Homo sapiens; identical to SEQ ID NO: 783105

SEQ ID NO: 783107 - protein, 113 aa, Homo sapiens
TVRLHSSALGWSNGTGRRGAGGGARRGGSGRTGALGVGGRLRAGRLLRVRGPPSPRPPGLGQPRKGLPQCSGGLKGSSSAAKVGAQAEEAGRASEGCEDCQHAVTSRFYFILG

SEQ ID NO: 783108 - protein, 84 aa, Homo sapiens
RCACIPQPLGGRMGLGAVEQGVVLVEEARAAQEPLEWVGGLGLAGCSECGARQAHAHPELQLAGKRGTQPRFPLAPLPPHLPAS

SEQ ID NO: 783109 - protein, 134 aa, Homo sapiens
WGGTVSTGNICQRHRKGFRKDNRRRGQIPSLPCTMQIEEVGSDSALYRACGFTQSSLLSWQETDQPSVGEGGGLLFSDHTLLQTLKQFPLNIFYFFQIKDDNVNREWHYSPWEAVFLHPRDVYVCTFIFLGVWM

SEQ ID NO: 783110 - protein, 90 aa, Homo sapiens
VALNGRQAEATRASPPRSPAEPKGSALGPNPEPHLTFPRSFKVPPPTPVRTSSIPVQEAQEAPRKEEGATKKAPSRLPLPPSFHIRPASQ

SEQ ID NO: 783111 - protein, 116 aa, Homo sapiens
FIEYYQQHYLAGKPVDNIYFLIIEKNTRSNECCYIIRSEEMRKNAGFDLPSWRAAWKGRRKASCAPCVWARGRRDEKQTAPGRTQSVCGTPEEFELSTDQGGGRSKTSVFCNIEGK

SEQ ID NO: 783112 - protein, 135 aa, Homo sapiens
PQVQMAPPVSLEPMGSLSASLENQLEAFLDGTLPSANEIPPLQSSSEDREPFSLIEDLQNDLLSHSGMLDHSHSPMETSETQFAAGTPCLSLDLSDSNLDNMEWLDITMPNSSSGLTPLSTTAPSMFSADFLDPQ

SEQ ID NO: 783113 - protein, 222 aa, Homo sapiens
GTHSSQKAACLLTPREKQAGPRPHGDTCTWPVCRLVTSPRLLWLQSLSLLGREPGAAKDLGNPDNQGPRSQNWVGDRERPRALQAQPVLNPDSRECRSNPGPLPAGQPQGSGVAQQAVPMLSCWLGTSHWVLWLGAREQTDLSFSCPTRPPGCAVCPGVLTFTGSRLHPAERGTSPGERLDSEARSVLSLYREAVPSMELELRDVGEKSCPSHNNHHRLLRA

SEQ ID NO: 783114 - protein, 92 aa, Homo sapiens
RGQKVRGTRGGVPQAGGATAASTTVGEALTQFPWSPRTQKLGGPQGDSSLYRVPVVSRLCARPTSLDHTLLMGSNGYLGFAAGTLGFSPVQS

SEQ ID NO: 783115 - protein, 204 aa, Homo sapiens
PHATLRLDLAGRELTDYLMKILTERGYRFTTTAEQEIVRDIKEKLCYVALDSEQEMAMAASSSSVEKSYELPDGQVITIGNERFRCPEALFQPCFLGMESCGIHKTTFNSIVKSDVDIRKDLYTNTVLSGGTTMYPGIAHRMQKEITALAPSIMKIKIIAPPKRKYSVWVGGSILASLSTFQQMWISKQEYDESGPSIVHRKCF

SEQ ID NO: 783116 - protein, 126 aa, Homo sapiens
PLFQVASRPMPVHTTSKRPCVDPELADRSATEMSGRGSVLASLSPLRKASLRSSSSLGPKERQTGAAADIPQPAVRHQGPEPLLVVKPTHSSREGGCREVPQAASKTHGLLQAVRPQAQDKRPAVT

SEQ ID NO: 783117 - protein, 76 aa, Homo sapiens
KHSLKICTKISGQGKSYHQEGTDLLAKCSDLAQETRCFSAPDIRLGQAVKCSKKCSNFDPAHLGQKLNGSTMILLS

SEQ ID NO: 783118 - protein, 55 aa, Homo sapiens
DWVMVGHSVDALNTTGLHTRMDLVLCELNLNQNTPDIQDLQLLPQYVPFNILCSN

SEQ ID NO: 783119 - protein, 116 aa, Homo sapiens
CTRSALPTPSRFLQGLACSTLSPSLSPGYPGHIPAGNMGPLKPRLLLHAPSQRWGSTALLSRELSPVFIHCSEGLAPAASSNCSWHLASSYAWHLPGNSLPGPQGKASSKFHQYSP

SEQ ID NO: 783120 - protein, 120 aa, Homo sapiens
SELLGRLKKRLWAELSGTNSPTCSPDRSPRLLQSGSYRSRRWGCYHAASHRTIALAQSTPGRGASYPGPLPTASHQSLISRAGVTRRGYCEEVWGGFSTFWPLDADQIIHRHPMVQVIVS

SEQ ID NO: 783121 - protein, 120 aa, Homo sapiens
PPLHSLRATRVDPLGPALPWGYGGSETSGSHRGAHISCRCVCCQEGLFKDSEVLQRLTPHGNSAPTNPAWQPLLRTLIQGRETPAKGGAEGSVEGHPWGLACCCPPLGRPAPPALLSGHC

SEQ ID NO: 783122 - protein, 99 aa, Homo sapiens
AIPWCLETGPMPAIHINGEQAGCFGLERCRHYPWWSFPSKWTCIKQLKNSGEMPQELGECEGEGGELEGAGHEGLWEETLAMAPLCWQQVAVSWPLVDC

SEQ ID NO: 783123 - protein, 78 aa, Homo sapiens
MMKVGRPSLVQLQDGAERQLRVRGPTQLPRPGSSSHEKQERLSRRRWPTRTRRCHAQGPDTHRASPCVQNAHRYIYRG

SEQ ID NO: 783124 - protein, 77 aa, Homo sapiens
MKPQSAGVDRHTTASPTCLDSCWLYHLRMGPSPLSLPCSAPSQLWGQSKSRSQDLLFLTGAVAMSQCQGLGCVKQDE

SEQ ID NO: 783125 - protein, 77 aa, Homo sapiens
PFCQYPYQFLLDYCNELQDDHTCSYPNFNGIPICHFDSSAQYTTFINKESSSKNPQVPPRFYKNGKKSHLAGLNATP

SEQ ID NO: 783126 - protein, 70 aa, Homo sapiens
VPWSCRFCSQQDDGQDRERLTYFQNLPESLTSLLVLLTTANNPDVMIPAYSKNRAYAIFFIVFTVIGECR

SEQ ID NO: 783127 - protein, 199 aa, Homo sapiens
VGCWMAEPQAESEPLLGGARGGGGDWPAGLTTYRIQVGPGAAARWDLCIDQAVVFIEDAIGYLFGWAHFQKWLGYVVLVVSLVDWTVLSLVCEPLRIRRLLRPFFLLQNMMKKLKWEMGLLIHLCLFTMFGMLLFAGGKQDDGQDRERLTYFQNLPESLTSLLVLLTTANNPDVMIPAYSKNRAYAIFFIVFTVIGECR

SEQ ID NO: 783128 - protein, 149 aa, Homo sapiens
FPDPVGRVLVLGCVSVVCARAPGGKDQATWREKEGPGAAYNPPKGTLCPRETDKKHCRSGLTSSSKYLFTWPPPTHSFSSASLSPTSLTPPTLPPWLWQREEDERESRCRCDGHHIDRCSDSGERRESGTEKKRKRGKYNRHCSTIKRE

SEQ ID NO: 783129 - protein, 50 aa, Homo sapiens
MSQAREQLDFQSRGMAEFKSIQETSPSRSPIFMAKTALVYFSNRITRSGY

SEQ ID NO: 783130 - protein, 143 aa, Homo sapiens
EAEPDSCTCPGTAVPQRLPGTSVRVTTKSLCGEFTRINCLSINFPLKPEKPQSFASSPGPGSSRYNWMLIVFVPKQTSMRSINNDQKPAGVLRVPLATSVRLHFSHRENSHRAFQDISGTETGFYTLLINNNHKPSSSTEYPG

SEQ ID NO: 783131 - protein, 119 aa, Homo sapiens
RRASGCWGVRDDGESGARPSRGDTAFQELSPGKLTDIFKEASWTFCFLLLITGFDGVSLFIFQVAVSRDCATALQPGHTARLCLKNKIRTLELRTIVELRTIVELRTIVELSIVEEDHR

SEQ ID NO: 783132 - protein, 72 aa, Homo sapiens
IQAFYLLLASFHPLSSLNLLHNPLLQPATCTSNLIIILDSVFFLTHYSVNHYDVLIFNISHISPYASISIAV

SEQ ID NO: 783133 - protein, 161 aa, Homo sapiens
VREGKLMFVRSEQRNEFWAPLLEKAYAKLHGSYEVMRGGHMNEAFVDFTGGVGEVLYLRQNSMGLFSALRHALAKESLVGATALSDRGEYRTEEGLVKGHAYSITGTHKVSVPHGWGGRPCPGITPTDDAAPGVPGLHQGAAAAAAEPMGLRGVDGGLERQ

SEQ ID NO: 783134 - protein, 118 aa, Homo sapiens
MRNLKASLENSLREVEARYTLQMKQLNGILLHLESELAQTWAEGQRQAQEYEALLNIKGKLEAEITTYRRLLEDGEDFNLGDALDSSNSMQTIQKTTTRRIVDGKVVSETNDTKVLRH

SEQ ID NO: 783135 - protein, 120 aa, Homo sapiens [sequence omitted]

SEQ ID NO: 783136 - protein, 88 aa, Homo sapiens
SLVHWTLLPSARLVPHLIFLSIVPSASKKKTSACQRPSFTFFSSRSTGAAILVHCKRLRSGSWTEIGWGRARLTLCAGLSSAPAHELD

SEQ ID NO: 783137 - protein, 120 aa, Homo sapiens
EIIPLHSSLGNRARLSPKKIKNKTASWVNLIPSKCGGYTGSQRSTHLSQETGLTSQPHHAVAPRFSFLVCEMRLTLTLPSSWRFVRIKSHESKGEGVMCYRNARCYSFLCLPLPCLHPCL

SEQ ID NO: 783138 - protein, 71 aa, Homo sapiens
AIERVPDRGFAGGWSFPTALTTERWNVALTSRLLLGMFCIPLPGSGQVASSKNEGQQLPKKKKREEEKDSL

SEQ ID NO: 783139 - protein, 61 aa, Homo sapiens
SIRISLSLIPLSLISLSLIPLSLISISFISAFSYFAILFFLEITSTTIPATTAIITTTITA

SEQ ID NO: 783140 - protein, 48 aa, Homo sapiens
FSLALESCRTVFNTNPSWHLVDIVLSTKPHSCCRRYLTLILLACVIHL

SEQ ID NO: 783141 - protein, 72 aa, Homo sapiens
PGSEASSGATTIRMKSERREEVMRMPPKEPTVGRRKLLASPWLTHETWVPLEPSQQLLTLLFPASRPGLGSL

SEQ ID NO: 783142 - protein, 71 aa, Homo sapiens
MNQPQEGSNGKESPRSAGLMNAVGTVHTYQPCLEFSMSGPVHPGPWTQSGLPRAALQVSLPTAQHRQGWDI

SEQ ID NO: 783143 - protein, 105 aa, Homo sapiens
TFIFKAGRQGRWGYRVCWCPVAAAVTNPQTGRFTAATSVPSQFWTPESKISVIEPTSPCGQGCGPLGKYPLLVSSASGGCQHFLADSRITAISASLCIAFSFLWV

SEQ ID NO: 783144 - protein, 101 aa, Homo sapiens
MGCGSNGNLILKAFAAIIFIFFVYPVPGKLSLVPARAARGDTKSFPRLGHLCASWWVRHVVGSPYGCLLAAPVLLGREGKSWTYQVKEPSWARITAIVGSL

SEQ ID NO: 783145 - protein, 225 aa, Homo sapiens
DERDSHCPYLLSSETTPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTGLPEASGASIDTSFSQGPGGIAEAFSPNNLAHWKGNPVREGPNP

SEQ ID NO: 783146 - protein, 122 aa, Homo sapiens
FHDIHGVLNSRCQCHFHDIHGVLNSRCGCHFHDIHSVLNSPCWCHFHDIHGVLNSRCQCHFHDIHGVLNSRCQCHFHDIHGVLNSRCGCHFHDIHGVLNSPCWCHFHDIHDVLSSPCRCHFA

SEQ ID NO: 783147 - protein, 83 aa, Homo sapiens
GSRPQSLVSGYSVELPMPLMHPWAHTCTLTHALVCTQTYVHTCMYTCTCIHMYTMHSCTNTRAHTPPSTWFLESIVLTSQGCT

SEQ ID NO: 783148 - protein, 57 aa, Homo sapiens
PPDSTSTWPKARRQPHPPIKAQEGNKHGPHGALETREALLPTGALPHSSVPHASTPQ

SEQ ID NO: 783149 - protein, 90 aa, Homo sapiens
PKLRLPIQPIWQKTEPKAASCWPHFRLWLLGPGVFGTGFVPCRPGRRAAEKSPCVVRDPSSSSTPCDPCCADLGENKGTRIVTQQVVWGC

SEQ ID NO: 783150 - protein, 123 aa, Homo sapiens
GELGGVYSGSISHKVTHSHWHMRAQRITLTHTGMLHLPQSNRHRRPHTKNLALTHRHLEAPGHTRTHRCGITHSGTCMWVQTHGTRAVTRSHAMKHTAQTQALPPSNAAPQAQLETHSTHTQS

SEQ ID NO: 783151 - protein, 131 aa, Homo sapiens
AGSMPFAPRSTVVFAPLSRDGGCRLCQRQAPPPYGAAHGPGCLPTCRGLSYRGILMITQGWAPTPYQEPETKEDLGRELGSPTGDVRERRREGLSSLPLCSEPPEPGIQSSGRLLQTSPVLMGVPKPSSWG

SEQ ID NO: 783152 - protein, 30 aa, Homo sapiens
MLRARINDIAWVIDIMSHFALKLIAMEGRV

SEQ ID NO: 783153 - protein, 122 aa, Homo sapiens
PVLQDMCSFPVAVLFMGSELLVVSQLGLAADHRHLLPHGAHWGSCLVPHSLSFFCGWFRHLNVLLFFTVLSSPAPEGMLSCSVQVACVSAVPHSHPFQQPKVSLGFLVSATFPSCLSWMMFA

SEQ ID NO: 783154 - protein, 67 aa, Homo sapiens
GFEVLRVVFRVVFLEALIPDLVEKDGMNVFLGGCLDKGVQPLGDKAEYKGSHSVTQTGVQWRNLSSL

SEQ ID NO: 783155 - protein, 50 aa, Homo sapiens
MFLLLWPPRCNKLAVYLDLCLIFLLLRFSLRIRFFLHLALMAPRFQKNGA

SEQ ID NO: 783156 - protein, 112 aa, Homo sapiens
SLPPPQISRSHSVGEDAQPHSPGKASSSSGEAGQEPASCMSDPRPCPEPGLSLPGWNMASPPRTPCPEARPQFPGLGFLAAPQARGCTSLPRQHSALVIGSEISRQAEKQHH

SEQ ID NO: 783157 - protein, 89 aa, Homo sapiens
FHDPRMDLNLQLEKPTTLEELIPYSAGSSIPDRWKLAAIFLVSSSLHVLLTNTPYTRPPVLKATTCFTSPHLCQSDFLCSLLDLQGPPG

SEQ ID NO: 783158 - protein, 117 aa, Homo sapiens
NSLGSGSAQGKESLEGGLLHSPPSPQNAQQLQRVSLRDKTAIIPIPNSSPQALRFCLKEESAHKQITPNLFPKELNSFATKHREVQTCLGVVAHDVIPALWEAEAGRSFEVRSLRPA

SEQ ID NO: 783159 - protein, 64 aa, Homo sapiens
MVLIASGSVARFNFGKRAHFLKICLHRLGQKHNVPLCALDGPWVLPGLPYLLPDGSLPSPAPAS

SEQ ID NO: 783160 - protein, 548 aa, Homo sapiens
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGAALVTLWNLMVVNNWQVFLDAYRRYSGPWSKIYFVLWWLVSSVIWVNLFLALILENFLHKWDPRSHLQPLAGTPEATYQMTVELLFRDILEEPGEDELTERLSQHPHLWLCR

SEQ ID NO: 783161 - protein, 718 aa, Homo sapiens
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLVLEISTLAVYRLPHPGWRPEMVGLLSLWDMTRMLNMLIVFRFLRIIPSMKPMAVVASTVLGLVQNMRAFGGILVVVYYVFAIIGINLFRGVIVALPGNSSLAPANGSAPCGSFEQLEYWANNFDDFAAALVTLWNLMVVNNWQVFLDAYRRYSGPWSKIYFVLWWLVSSVIWVNLFLALILENFLHKWDPRSHLQPLAGTPEATYQMTVELLFRDILEEPGEDELTERLSQHPHLWLCR

SEQ ID NO: 783162 - protein, 642 aa, Homo sapiens
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLPMAVVASTVLGLVQNMRAFGGILVVVYYVFAIIGINLFRGVIVALPGNSSLAPANGSAPCGSFEQLEYWANNFDDFAAALVTLWNLMVVNNWQVFLDAYRRYSGPTSFTSGTPAATCSPLLGPQRPPTR

SEQ ID NO: 783163 - protein, 303 aa, Homo sapiens
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGHVSI

SEQ ID NO: 783164 - protein, 31 aa, Homo sapiens
MFLSPFQDFELHHLLDPVFGFYRDPILTHQH

SEQ ID NO: 783165 - protein, 174 aa, Homo sapiens
MAEPQAESEPLLGGARGGGGDWPAGLTTYRSIQVGPGAAARWDLCIDQAVVFIEDAIQGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKVGHPWSGSGNGAALCCD

SEQ ID NO: 783166 - protein, 752 aa, Homo sapiens [sequence omitted]

SEQ ID NO: 783167 - protein, 667 aa, Homo sapiens [sequence omitted]

SEQ ID NO: 783168 - protein, 552 aa, Homo sapiens
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLLKEVLTSGTNPWGPGPSSDFSPKAPFGENVLEMSFIIIP

SEQ ID NO: 783169 - protein, 38 aa, Homo sapiens
MWATGSLPDFPAAAKFLGFRQRCIPRSLCLSECPLEPP

SEQ ID NO: 783170 - protein, 184 aa, Homo sapiens
MAHEQEEFVKEKATPGAAQESSNDQFQTLEEQLGYNLREVCPVQEIDGKAGTWNVELAPKREISQEVKSLIQVLGKQNGNITQIPEYGDTCDREGRLEKQRVSSSVERPYICSECGKSFTQNSILIEHQRTHTGEKPYECDECGRAFSQRSGLFQHQRLHTGEKRYQCSVCGKAFSQNAGLFHH

SEQ ID NO: 783171 - protein, 71 aa, Homo sapiens
RLPGREVVVKVRMLHFHLKDPNLKINKEQYDKQNIYRYGEYITKRSAKRIEQEIGRGGLEGHCISQRLENP

SEQ ID NO: 783172 - protein, 71 aa, Homo sapiens
WDSSLWSTAGFLSLSAVDTWGQVLLVMFSSIPGLYPLMALAATTLVTTPDEDHMHIHIENPWQEGGKGVEA

SEQ ID NO: 783173 - protein, 127 aa, Homo sapiens
NPNIQRQPSRQSERPRPQPVVLRGPSAEMQGYMMRDLNSSMDMARLPSPTKEKPPPPPPGGGKDLFYVSRPPLARSSPAYCTSSSDITEPEQKMLSVNKSVSMLDLQGDGPGGRLNSSSVSNLAAVG

SEQ ID NO: 783174 - protein, 138 aa, Homo sapiens
MTRKTEDKLTRPHQQATEQTTTSKENTRREGATETVREQQETYQSQEEKDNRKKNMKARTYKTRKKETSQIEQATKEERNRETRDNIEDNNKRQTTRKKHSTRETKLPTQTTQQRKQSKNDHYVDDQEQNKREDQQQT

SEQ ID NO: 783175 - protein, 55 aa, Homo sapiens
MRHLDKPPDHNLAPSSVLTQPVVPAMLKWLQEFPLQPGVQGLTWSQLSAHMAWGK

SEQ ID NO: 783176 - protein, 130 aa, Homo sapiens
LMRLSHVNIPCHLKSWRHPPGEGRRALTSSPLFSSRDLARPGVGRLGASRAGDREPLGRGGAAGRGRGGGAGPQPPMPGARAGDPGSPARGRGTENEPSVAWRRIPPSGQNFPHLAIRKGSQHSHPERPR

SEQ ID NO: 783177 - protein, 141 aa, Homo sapiens
AQCASSACSREKERKLRRGSVGFSTSDNHVFPDRRPEPCSFAIRRGLQRASSSIWAPLPRKSPAIPFRTGSLRGEFSSVDSDLLRLTSLGNPASRGTSAAGHTGFTPAPPHQQAHSQVVRLRMDHELSKRKKVEILNYAAI

SEQ ID NO: 783178 - protein, 120 aa, Homo sapiens
AQCASSACSREKERKLRRGSVGFSTSDNHVFPDRRPEPCSFAIRRGLQRASSSIWAPLPRKSPAIPFRTGSLRGEFSSVDSDLLRLTSLGNPASRGTSAAGHTGFTPAPPHQQAHSQRRK

SEQ ID NO: 783179 - protein, 120 aa, Homo sapiens
AQCASSACSREKERKLRRGSVGFSTSDNHVFPDRRPEPCSFAIRRGLQRASSSIWAPLPRKSPAIPFRTGSLRGEFSSVDSDLLRLTSLGNPASRGTSAAGHTGFTPAPPHQQAHSQIKH

SEQ ID NO: 783180 - protein, 120 aa, Homo sapiens; identical to SEQ ID NO: 783179

SEQ ID NO: 783181 - protein, 80 aa, Homo sapiens
AEQEIPGENPSARTPLNTREDSLPSASPPGLLHFPQLPKGSRLPRTRDHVCSVGPTATIRTQLRAQRCSEDRQWICTSGS

SEQ ID NO: 783182 - protein, 129 aa, Homo sapiens [sequence omitted]

SEQ ID NO: 783183 - protein, 112 aa, Homo sapiens
RPLFSDHLIMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 783184 - protein, 106 aa, Homo sapiens
QFSPTQLPAHLSFRPIPFCPSMWGWAGSSLSPDMHSSDQSLRPLCPPSTRDPAGTMGKGIMEGVPCPLSRRPAPWLLPAGGHLCCGLSPPQSCGCRAGSPGAPAEL

SEQ ID NO: 783185 - protein, 43 aa, Homo sapiens
TKEDSHVSPAPHCTYDSTSKEFILNFPDNLSSVVSVAMEVGKR

SEQ ID NO: 783186 - protein, 59 aa, Homo sapiens
MLRIPILPFLSLPWSSSSGSSRGFERTGSPALPLRFTPLCWRSQSHCPIRAPECKCEAC

SEQ ID NO: 783187 - protein, 61 aa, Homo sapiens
TFKVKQCKETFHAGRGGQPHCLSAFVEFHFTVGFSGSTPLVPRGQSPGLLLCGMLWPVWGS

SEQ ID NO: 783188 - protein, 145 aa, Homo sapiens
TLYPPLEPTQEDGLRPRVQSPIDLHSQTWARCHGSLLLSPPFGRPRRLENLRLGVRDPPGPRGETPSPLKIPKSAGRVGTRLPSPLFGKPRKENHLNLGGGNCSELKSCPCTLASASEPHSVSPKKKKKARNVKRCFNRTDYRIQ

SEQ ID NO: 783189 - protein, 77 aa, Homo sapiens
VRDGVWCRGAWVKGKAKAVQTGLLAAALLPGPNRHRDWEPPSRFLVALLPSPKWLNFVWIPCWRAGPGALLAVTAPQ

SEQ ID NO: 783190 - protein, 82 aa, Homo sapiens
VSYKVLRNETVLEFMTALCQRTGLSCFTQTCEKQLIGLIVLTRYNNRTYSIDDIDWSVKPTHTFQKRDGTEITYVDYYKQVG

SEQ ID NO: 783191 - protein, 35 aa, Homo sapiens
MKKSPGAEDLEQCKKPHTSKTGSWDEIHSSTEEAN

SEQ ID NO: 783192 - protein, 142 aa, Homo sapiens
MPSGGLGIAQPSSPPLAPQHSSQDMLHSTCLCHYSWHPAVCATCRSEVWPAQPFITNTNMNCLIPREFSHHWSQAMRATSGRDHYVSQCGSRTRGLSQVGCTQPGGDRAEKARSGGTRVGEPATHGNRGESRGGRSTKEQKI

SEQ ID NO: 783193 - protein, 112 aa, Homo sapiens
LPRLECSGTILAHCNLCLLGWINSPASASRVAGITGAHHHAWLIFVFLVETGLRHVGQAGLEPLTSGDPPNLASQRAGITDVSHRALLEEIFVVWISDQISHNIPLSQTLSQ

SEQ ID NO: 783194 - protein, 72 aa, Homo sapiens
IREVVERGERGTWTERRIHLELRNRTRQLFENLSVDIANKIRNIKRLTLEHRKPVTKFLNNNRQLRKENDHG

SEQ ID NO: 783195 - protein, 120 aa, Homo sapiens
RPSPFGCPSPFVCPSPFVCPSPFVCPSPFVCPSPFILFLKTTRTTKISINVENINERQIYNLMTSTNNYFNMLDSSPLFLMRILMLGSKHFNYSSFEEVEVQRNPDKFSSFFYVTPHLLF

SEQ ID NO: 783196 - protein, 37 aa, Homo sapiens
MGGHSPLQERRQMVNLIYAACKHGNGTLPVKQVGDID

SEQ ID NO: 783197 - protein, 141 aa, Homo sapiens
ASELYKNLKKSLPTTKKLRLNCRKKRQRLMSFKQSYKLLSLSLVPCQLIVIFLCLPLKKVELATQHFLLRLHCLLVEGCRSTPPPHSSTSRNADAIQWSCASTTPLGFLWRTKFSSSTNPAIGLKPTERIKPEISMRRLNG

SEQ ID NO: 783198 - protein, 128 aa, Homo sapiens
MSPKLTPFCCSTGLQVQVTACCVHSRELHFLEELASRGWMSDWVLFCPEKNGRCFLRNSLGSGEVSLGFEPPTSQHGDFCCIPAAERGQPQPPAPPLTLSDPRKPPRDPQVTSPDLSCLCPPPHCVPL

SEQ ID NO: 783199 - protein, 66 aa, Homo sapiens
SSSPPAIRPPPPPPPFLQTRNEVMFEAMRVILGPSGSQENASLGPCCHYAAEPTLESSSPRLIIMG

SEQ ID NO: 783200 - protein, 104 aa, Homo sapiens
HGDIACSPAGLVWRSCCGLVSTDVAAAVLLNRRLLRENALQGAEQLGEIIRTLNGELCPLLLWDPLASPGLSLGDWLFTTSKRVIPRNHSSSDCFPDLEGQGEA

SEQ ID NO: 783201 - protein, 94 aa, Homo sapiens
GDKQYKCDVCGKLFNHEQYLACHDRCHTVEKPYKCKECGKTFSQESSLTCHRRLHTGVKRYNCNECGKIFGQNSALLIDKAIDTGENPYKCNEC

SEQ ID NO: 783202 - protein, 122 aa, Homo sapiens
SLWYPGWSAVAQVIAPCSLDLFPGSKDPPTSASKGVGTTDVHHHTQLVKKKIVEMGSCSVAQAGLKILGSSNPSNSAFQGAGITGVSHYACFLFVSFLLVELYLDKFLKEDKTEVFPHSLKS

SEQ ID NO: 783203 - protein, 30 aa, Homo sapiens
MREAQVGNEAVQGLRPRPPVPYCSILPVFG

SEQ ID NO: 783204 - protein, 107 aa, Homo sapiens
PPGPRGFDDQRAPPREPHLFPAGLERPEREAAEHGEPTIRDAWPNPLPFMGAGRNGVAADVPSLIPKPHKSQNTHANSHQRISQTQKLKTTHENITRSPTKTYSSKK

SEQ ID NO: 783205 - protein, 108 aa, Homo sapiens
PELADRSATEMSGRGSVLASLSPLRKASLRSSSSLGPKERQTGAAADIPQPAVRHQGPEPLLVVKPTHSSREGGCREVPQAASKTHGLLQAVRPQAQDKRPAVTWQPG

SEQ ID NO: 783206 - protein, 112 aa, Homo sapiens
RTYMNWTGRGWTCVESVIASTDITVQKALSFVLLAVFLIQQGILISGSSMRVNDSGIAGITLDKEMIIVRSKEVQRQEGNFSFFLRDPLQEHINKPNVKNHSLKADFKVTTL

SEQ ID NO: 783207 - protein, 102 aa, Homo sapiens
TQDRRQGEKHTRKLRLRQCHRHTKKQQSQDRSERKNHTKRQKRKHHEKQTKEWKKGKDYRVSKRGQQNKRIQRKREKRTGGNQTEADERQRWKINKGLRSRM

SEQ ID NO: 783208 - protein, 109 aa, Homo sapiens
SAASTRPLQQRPPGPPRALPRLHGSPPPGPSCVDKGYPSQKSSHLDSGHPPGTPWEPHPRGPRPQPASTRVPRPPASPPTSNAKQRHVSELAGGPEAAGPALSGRAQRP

SEQ ID NO: 783209 - protein, 145 aa, Homo sapiens
DPCQGAEKRCTHHGRHDHTHSPWPLHTNTNPNWQEQRDQETVPRVRNPMCSDSSVSKISPPTGCQESPPRGPLHRDSAPLLGLSLSWKPAHLEAPCPPKWNTGTGSRPCPHHLLQAGPHHATETGRPGLRDGAFLTSLVTPSLTR

SEQ ID NO: 783210 - protein, 308 aa, Homo sapiens
HSCSGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGAPAYGPFVSHFWLHQAYCLGCGQPQDEGDMENTVSCSTPGCQGLYCLTCFRLLDNTCSVCASPLSYQGDLDLELDSSDEEGPQLWLAAAQRKDPEQAWLLQQQLQEVLGRSLSMESTSESSDLDEEKGPQQRKHGQQPLPEAHQPVSILTSPEPHRPPETSSATKGAPTPASEPSVPLSPPSLPDPSHPPPK

SEQ ID NO: 783211 - protein, 118 aa, Homo sapiens
TLNPTSGSLLKAVDGGPSHFWASATAAVGAQRSEVRCNQRSQTSRTRSCRKRNASSSSHSSTEGLPELKRRRVSASSRCQLALSSSKTVSEDGPQAVSSGHTRCEKAADTAPGQTLTP

SEQ ID NO: 783212 - protein, 106 aa, Homo sapiens
KREEKGRGGTKRPEWQSCSDSSGLRPALGKPGWGDFKVNYTTCFQDAGMKVLGRHNYLRRHSSRAVEEPRLLSVGILCPRWAFLLFVFEMESCSVTQAGVQWRNLS

SEQ ID NO: 783213 - protein, 42 aa, Homo sapiens
MWRGRQHQWATDLTLSRTDALDGCYVAFSEVTGMKDHWALDE

SEQ ID NO: 783214 - protein, 97 aa, Homo sapiens
ECSGEWYSLYGKQWKMGFHYVGQAGLERLTSGDPFAFASQSAGMTDMSHRTRAHPLILRWLIRQSSPAVDECLHLKSSWDFIDLMNVQVPGVKVPRL

SEQ ID NO: 783215 - protein, 106 aa, Homo sapiens
YSFLYFPNIYEVFTLCQTCVRKDTDKRSNPYPQGAAYMIGKAKTERKPSCTLYKVLFLSAVSVLFKSDSPLDPMPSWVLAKARKASVPLVYAGLKNHRSSSHILQP

SEQ ID NO: 783216 - protein, 37 aa, Homo sapiens
KVLGAGKQIRWFQAVRMDVLPSASEGGGVAQVPAVPF

SEQ ID NO: 783217 - protein, 79 aa, Homo sapiens
QSCPTGCRWHLGLSAADNNMQTPPSPLLELENKQTTHSLPDSGSNICLRKGRGGGTQKLLGGKGVGLPAVPGPAPPHPT

SEQ ID NO: 783218 - protein, 106 aa, Homo sapiens
APEEWKNEIGKKASSQRGWRGLLEARVWPRGVELLCVSRNPLPPGLVRTCLRGPSGSSSEVDRKGQAHCLRTPPWGVRATSALEKSPSIPLPVLRPLPYHQTSSEA

SEQ ID NO: 783219 - protein, 110 aa, Homo sapiens
MIFQTRRPSRKAQRVPCPQTQLLGRCPVTSSLLYRMIPPRSLGRCAPGTRDFLSVVIRGEMDPLIGSFLMERRARVSLRSAADQGGPACPGAPGAVLGVRLKGQTLMAYG

SEQ ID NO: 783220 - protein, 108 aa, Homo sapiens
IHTPLTVTLETLALAHPSCASPCSFFPVIPALFSLSLLRSLPWWLPTDVLLASAVLPMPPIPSKQADLLGAVALARPDMDSHSVCLSRHAFSLESSLLGMVCFCSVLL

SEQ ID NO: 783221 - protein, 118 aa, Homo sapiens
EPSGSRGASPQGAGERALLAEERKDSSRAFVEQKEGQWAGMHRLASGAVRPVTSRRARHHLWCSSLCPTSWNSAGNMVHTQEIFGQLQWLTPVIPALWEAEVGGSLEPRSSRPAWAIW

SEQ ID NO: 783222 - protein, 41 aa, Homo sapiens
MTGIVPVIGGGRLKSQSRPGEGVICLPFKPHDTATNTRGAK

SEQ ID NO: 783223 - protein, 80 aa, Homo sapiens
QQLLLMKRKGGPVTWGYEPTNLTTCLLLRVTYDLSGSRRGATIPCGQGLPLPSVSCMPLSGPWPCLPLTALPFDVCTSSH

SEQ ID NO: 783224 - protein, 65 aa, Homo sapiens
ICSSQTAYISNDAGSAHRACSSRSAFGSNKANSSTDGHSSKNSCESTSVGSSSGTHNSKNSPGSE

SEQ ID NO: 783225 - protein, 67 aa, Homo sapiens
AQQQPLNPDPAGENLIDTDARTRGIAWETKPGVDAETQPRERRNSFGVSPFLGRPGKLLRFTCASSR

SEQ ID NO: 783226 - protein, 64 aa, Homo sapiens
SGSRPHVFLHSAAAAFLLSKTTRWLKSNIFLLEGKGHLLTLALLSTVDTWLLFPASLHVSRSPN

SEQ ID NO: 783227 - protein, 38 aa, Homo sapiens
MPVAKLGPSLPGEMGELVIPRESGRQNYMFPDFTLASE

SEQ ID NO: 783228 - protein, 86 aa, Homo sapiens
PSSVRTSGHVLVTTYVLLCSFYQVCWPCPSFPGSERCSRHLRSFSGCGSTALFLVAQCPVLPLRGGALFLVAQCPVLPLRGGALFL

SEQ ID NO: 783229 - protein, 91 aa, Homo sapiens
MELPAGPKSPETSIRLFLSGRVAFKGGLRTQGPLHFPGPEPQCGNHILQTHSAPQIPIQVRRQKVTAFQAYVDPASVFLVSPASEVWRSMF

SEQ ID NO: 783230 - protein, 134 aa, Homo sapiens
AEVVRGLAVLQPLQQPQEAAHLPPQVRENTHTASERGNASSSQKEKVLPEAGAGEDSPGRNMDTALEELQLPPNAKGPVKQISPRSPQAAETVGRPAGPAGLRRPPDKQPSDHSYALLDLDSLKKKTLPHSEGK

SEQ ID NO: 783231 - protein, 37 aa, Homo sapiens
LQKHLKEWSINSERRLTDCWLLSASSAVFKASYLLIV

SEQ ID NO: 783232 - protein, 131 aa, Homo sapiens
MQPIPSFSGSTWAEDRCRGAQRRALTSQETQFGVAIVTHSPGVCFDLPLPPYYFFCYLVSPWYLRILQLPSGLTDGRIKEKWHRFHLKSYKHFTRWYSLGRAFVKQMPAHCFTLLISTSAKHFSRKADPEQ

SEQ ID NO: 783233 - protein, 108 aa, Homo sapiens
WEKRHVNSIPILFLDGLRFVLIHAGQSGRTMKRWTSEFERNWSYPREVRPPPTCNSLASWIPKQRQSLALSLGLEYSDTITVHCSLDLPATQEAEAEESLEPRRQRLQ

SEQ ID NO: 783234 - protein, 80 aa, Homo sapiens
DLVNVTLHVTSQGKRDFAEVIKLRILNYRDYPGLPVWAWCNHKGPLEREAGRGVKGDMMTEQRAERDLKILCCYFKNGGG

SEQ ID NO: 783235 - protein, 118 aa, Homo sapiens
VRPCPPNFKNQHFIHLAAQDKSSGKPCQIHLLNTPQLASSRHCHCHDLSRPHPIHATWTTEAASSLAGFHSAGMQLIPCGMLITSHSPVLRSQPLAAASEALCKLQSSGREFSSSRRP

SEQ ID NO: 783236 - protein, 108 aa, Homo sapiens
VFPNFPGRLGGALSVGRKWGSEELGVHSGSHCKLGAELGWETLRQMLAPGHLQAVAYDSCCLTDHTAEHSCPGLQQGLGTQSPRERVLPAQPREGFSGEVSLMLGLSG

SEQ ID NO: 783237 - protein, 33 aa, Homo sapiens
MCVDVKVRGIDDLKISCGSENEEKYLDTECEEQ

SEQ ID NO: 783238 - protein, 98 aa, Homo sapiens
SHECSQEMVPCMHRSSQTSIHHIKPGICVRRHAFILQAVYKTALAFVFCLLQSLKVSQKRVTGNFFIPISLLASHHCHNDCQFPGLNLESQKQLFLYS

SEQ ID NO: 783239 - protein, 76 aa, Homo sapiens
NSLGVHGPKRETDSAKNQKYPHRSKQASDGKEENFPFKVWTFLKDSPLSLYKPHAPLKEHNQGPMNLEQSCQLRVN

SEQ ID NO: 783240 - protein, 97 aa, Homo sapiens
RGQALEGGALVLLSVFTSERGLGAGPVDGQQLVGTQPQPGGRGPRTLPGSFRGVPLPEMEAQGGKETPQVAGAPGACGVPDHSEGGEFISSVSTQQG

SEQ ID NO: 783241 - protein, 112 aa, Homo sapiens [sequence omitted]

SEQ ID NO: 783242 - protein, 62 aa, Homo sapiens
MDSLEWPGAPGKQRRSYLAAHFKNIEILLELVKGHFLSLECADLNSPGLPSHSFTHKHLPSE

SEQ ID NO: 783243 - protein, 55 aa, Homo sapiens
ASQPTVTTENSEDDKEEEDVPQTVKSPQSPAKNGSKPVHSNQHPQSPAVPPTYPS

SEQ ID NO: 783244 - protein, 52 aa, Homo sapiens
MPGSPLSYSAHVVYLSLSEPWSDYGTQTLPVRTCECALDTETDSEDGEPSQD

SEQ ID NO: 783245 - protein, 79 aa, Homo sapiens
KGPGLYEPRGKIGSSEPGLKHLLPGAVIVIPAAPCGLQHGPDFSEPSALFFSESPTLQGTGSGGQQTGCICSMSHTFHG

SEQ ID NO: 783246 - protein, 36 aa, Homo sapiens
MKCQNVRHIRRAQDSSSIAPLTQHSIFGTRGTVVPL

SEQ ID NO: 783247 - protein, 102 aa, Homo sapiens
PSPLMGDLGTVAGMWEAQLSDAGSEEQSWLAWGGGVTAVSGMRVRPHTATYWICDSRSRHFLFPDLSFLVEMGSILLRISELVKGEPEMHASQEPAQSPGIS

SEQ ID NO: 783248 - protein, 126 aa, Homo sapiens
MQGGQAGQVPTAPHEGLVSPDEVSTRATGTVLVALQQGLRPGHAEDSGVPRLALFDVREPQHWQVPLPFPRARNQSKADSSFHRWHPCLVSCAGCHLTSVRFRPACHLLQRPGAPLRCWCFTFGQF

SEQ ID NO: 783249 - protein, 74 aa, Homo sapiens
PRGHPLCPGATPSGSDSVQLTLPSLRVLLPPAARAPAAIGAHERADQAQVAASPHPLFPGPTPLPGDDREAQRP

SEQ ID NO: 783250 - protein, 42 aa, Homo sapiens
EEQFRSVLEGPSICVCLMFPPGTGMLQKQCCVLSVSHQETLG

SEQ ID NO: 783251 - protein, 155 aa, Homo sapiens
IINMVLELPIQNEPPGQAAAEEKHTCVVQYILFPPHSTSTKDSFSTDDDNDVEVEALEGDSELNLVTEVWVEPQYGRVGPGPGIWKHLQDLTYSEIPQALHPRDAACIGSMLSFEYLIQLCQSKEWGPLPPEPRSLMDWIREETPASMRSLSILT

SEQ ID NO: 783252 - protein, 70 aa, Homo sapiens
YVLDSVTIGMVVCACSSSSRGYGRRICLYPGCEGCSELRSCHCTPGWLTERDSASGHGGAHACNPSYSGG

SEQ ID NO: 783253 - protein, 68 aa, Homo sapiens
FDGRIQYWVKISDLSQEHRNIGCPDKHFLDYGCGQELGKTTHTHTHTHTHTHTRILFSHKGRMKSCLL

SEQ ID NO: 783254 - protein, 109 aa, Homo sapiens
MPVNTSRAPKAGCARRIRPSNLRGEQSPANTVTCSSGLQNCENINVCCFKPPNVWFFVMAALALLSLNHHHSALPLNIPSKSHLKQPCLNRACLGNVEKRLSPFYEFAA

SEQ ID NO: 783255 - protein, 45 aa, Homo sapiens
VFDDDVIQVGSLQCEASKVQSPPPTAQSLALWGWKPDITHSSRNT

SEQ ID NO: 783256 - protein, 181 aa, Homo sapiens
MAQIFPVQTVAVAAAALARPCGALEGAFLSDQSWNLACGSKALSQSTLQQVWAALYSSPGCRTPVSLKGTHAYSPDHRQKKHRKLSELENLTKCLTVMRGEMRERGVTEVSPTYSSDPESSDYGHVQSPPSCTTPHQMYVDHYRSLEEDQERIVHTKKPGKGTAMLSGRLGASKNELVNPG

SEQ ID NO: 783257 - protein, 68 aa, Homo sapiens
RARALQLPYPDVSPPSSAVGAVGPGRVVFKERVQERPELLGHSGTSVGPGAARNSAGGTLGVPGSGKE

SEQ ID NO: 783258 - protein, 105 aa, Homo sapiens
IRRSHTRRRRNAVLTHKGSMRYSHTGEVRMRYSHTGRSRNAVLTHGRSKNAVLTHRRSKNAVLTHKGSMRYSHTGEVRMRYSHTGEVGMRYSRTREVCGTHTQEK

SEQ ID NO: 783259 - protein, 76 aa, Homo sapiens
MWDSVQNPISLEHGNTWQTSHPGRTGALRCLLPCFRRRHRPPAAHLWMGSRVGRPPTGRTLCPMALLRPARRPLTA

SEQ ID NO: 783260 - protein, 83 aa, Homo sapiens
LYQVLGTEPNRQECSHFAGKEKCGPDHGGSPQQRSSASPEGGRKEQCALRGSLLPSQHLEKKGSGMRRGFFSQSHKAEGILPV

SEQ ID NO: 783261 - protein, 148 aa, Homo sapiens
KNTIKQKTGESDYIKSNDFSSTHFKDPSQSAAYIFTLSKVSSVHFLWQGLGKRLYGAVSGHEDGKKPLRQPKKQAQERDRDDEASSRKQNRPEPQGAESTGRREAQPQLELRPLAESTLLPLPGRWRPGLHSCFNTCTPARTAFAIFS

SEQ ID NO: 783262 - protein, 54 aa, Homo sapiens
MLRRSLAFDKLLIQEASQMHLKMCPFRGRKHLPNSRLRSKRGGYSCRVLLAALS

SEQ ID NO: 783263 - protein, 69 aa, Homo sapiens
IRIHLSAWQWSARSQQETIDKKVPRGLGRVEAELSFRELEKSWRGRPKKKQFMINLLRVFVSNPIPILT

SEQ ID NO: 783264 - protein, 146 aa, Homo sapiens
LDAMNRDCGIPLSHLQVDGGMTSNKILMQLQADILYIPVVKPSMPETTALGAAMEAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 783265 - protein, 117 aa, Homo sapiens
LDAMNRDCGIPLSHLQVDGGMTSNKILMQLQADILYIPVVKPSMPETTALGAAMEAGAAEGVGVWSLEPEDLSAVTMERFEPQINAEESEIRYSTWKKAVMKSMGWVTTQSPESGIP

SEQ ID NO: 783266 - protein, 122 aa, Homo sapiens
SLRPISVNQRGWLVTQPCLQATNSTSCPVTYCYQVAKILPEGYVGKLLHSFGSHYQSLVYEPPNNINSNQWCKPDGRRCAHQEEQYNRFMKLVGGKRRSRSKSSDPDLRRSLDKQPTDSGGG

SEQ ID NO: 783267 - protein, 211 aa, Homo sapiens
LSHALRGEACPVRVRGGIYPTIRRRFDLEPQWQPSWDPKGGREGGLLSAMQPSEQRGCNLGRDKVQVTCTLIGPLLKPLSQSFHLGADRWSSLLNVVLGLRPGWTRFCLGGCTWQPLVAFLGTGPAHSTTSTSALAPQQPLESNRVGPGPGPWEGLLQGIQCCWSGAVLHMGPESRFLVKTSRASSLGYSDSLPALILGTSKMGCSCLPCR

SEQ ID NO: 783268 - protein, 77 aa, Homo sapiens
YQIFDHAFYLFLGHIDILCRALQGDLVFALCELDVNLWHLLSDFGGSELGMGGHLSMTSHMSGHRHPGHPSWVSNRF

SEQ ID NO: 783269 - protein, 149 aa, Homo sapiens
FPSIPLPREWRKGVRKTSIRFDWRKTQRWRRIHTSLGGRPSGGRLDRRRERRCDAPGAPSFDATGITSESSRHEGALPRGLDAVEAGSSSTTRAQSATRPPQCHCLPALPPRAAAPPSPRQPGRESQASAPERTHSPRAPSRAAPTARP

SEQ ID NO: 783270 - protein, 75 aa, Homo sapiens
ALGVGRSQEEACLVEEAQTPMMIPQDWGQRVKEVHLQTADEGGQAGRAGSELPEVVQLLSHGAHPWSPSRRHKIR

SEQ ID NO: 783271 - protein, 140 aa, Homo sapiens
THVARVPLLCFHSPILGQVTVQQLQGVRPDGYLRRGSWKASWAGPGRDSGLGSLAKSPLSPCVSLFPATPMDPVLLASPAWGPTTLSPRNPMSCVLTDTSSPFPPAASPYYLPFPTHSECSLLAPVPSVLTLLIPSWPST

SEQ ID NO: 783272 - protein, 85 aa, Homo sapiens
RPFRKHGVVPLATYMRIYKKGDIVDIKGMGTVQKGMPHKCYHGKTGRVYNVTQHAVGIVNKQVKGKILAKRINVHIEHIKHSEPR

SEQ ID NO: 783273 - protein, 108 aa, Homo sapiens
MPAACLFRNNAQSFLVLRNLQPTLPTACATSFRHLTLALPTLLSTVFQTYHSNCLPFLPSLPHEVGPACLCLGHALGSSKIYENCKVVMLGEVARVFSHFCLNSLVRR

SEQ ID NO: 783274 - protein, 102 aa, Homo sapiens
TGSQEPAPHGTEHSPSPCQLKVPHKVRISQNHWPDAHFNNRKRRAASREAPLLGLQLSSFLHDRKNVCYGSVEAKLTYKLGNGRRGPPRPLWAPAGPPHPAS

SEQ ID NO: 783275 - protein, 110 aa, Homo sapiens
LSGAQRKCLVRTCSSQQVCHVQGVAVSGSLFRVVVQGGSIARVGFGQEHLSHGDSFLLTAFPPGRAYRVLFLLLVILKLAYQYLPVLSLTSILCRNTKKILNYLFCKIPK

SEQ ID NO: 783276 - protein, 50 aa, Homo sapiens
MVECLLLLGADANQAKEGSSLICQVCEKESSPKLVELLLNSGSREQDVRK

SEQ ID NO: 783277 - protein, 102 aa, Homo sapiens
EEKIHEQEKIREEEKRQEQEEMWRQEEKIREQEEIWRQKEKMHEQEKIRKQEEKVWRQEEKMHDQEEKIREQEEKMWRQEEKIREQEEKIREQEEKIREQEE

SEQ ID NO: 783278 - protein, 34 aa, Homo sapiens
MVACENSTLQTRCHIYLRIHTFHQFGEETQKRGF

SEQ ID NO: 783279 - protein, 65 aa, Homo sapiens
LSTWADENFTSVLFHKPTRVHTYTHTPTTDSRRRHTHQPDTSYTFSHVRAHTYTFSASYTFHPRS

SEQ ID NO: 783280 - protein, 70 aa, Homo sapiens
PALVTPLLLRAPRTAGNLLKNLGNFPEAGSPVSSPSVILKLTNTQTHTFRLSVQGKRSQTHLEMHRFFFF

SEQ ID NO: 783281 - protein, 171 aa, Homo sapiens [sequence omitted]

SEQ ID NO: 783282 - protein, 152 aa, Homo sapiens
AVREVPTSTQRGGRVGAVREVRTSTLERGPRGPRQGSTDKHTERGPRGRRQGSADKHTERGPRGRRQGSADGNHSEAPAHSPGGSDNQINCRHLELSRPRGGGLVHTRPSNAAEPLWTASHHSQRWPSSPVPGSLLKRNENRGSHINANVYH

SEQ ID NO: 783283 - protein, 236 aa, Homo sapiens
MAFPHLQQPSFLLASLKADSINKPFAQQCQDLIKVIEDFPAKELHTIFPWLVESIFGSLDGVLVGWNLRCLQGRVNPVEYSIVMEFLDTGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPCHSPPAQGGPAPHRLPGHQPCPLLPMASTTLAS

SEQ ID NO: 783284 - protein, 207 aa, Homo sapiens
MAFPHLQQPSFLLELHTIFPWLVESIFGSLDGVLVGWNLRCLQGRVNPVEYSIVMEFLDTGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPCHSPPAQGGPAPHRLPGHQPCPLLPMASTTLAS

SEQ ID NO: 783285 - protein, 153 aa, Homo sapiens
MEFLDTGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPCHSPPAQGGPAPHRLPGHQPCPLLPMASTTLAS

SEQ ID NO: 783286 - protein, 82 aa, Homo sapiens
MKLVYKLQAEDYKFDFPVSYLPVSKPQWREWCSGQWALHSPVVMGNLLQSSEGKLRSDSFQGCERQRKWVLHDCYPCCLQLF

SEQ ID NO: 783287 - protein, 86 aa, Homo sapiens
QDFTEEVVDFMRPTEGQSEDENHMDQSQEGATLQEVTARVMQTLQVMITEYRRGWQMATSRIAGDVGTRCHARLDNLQKHFLMFFN

SEQ ID NO: 783288 - protein, 130 aa, Homo sapiens [sequence omitted]

SEQ ID NO: 783289 - protein, 92 aa, Homo sapiens
FRGSGTNDSQLPDEAAFLSPGPRPAKVAVLTAAALPGENTLAMLSFLTGDRGDVHGTQRDGLKQENLKTALTLGGPLQPKALLPSWEGHSYS

SEQ ID NO: 783290 - protein, 111 aa, Homo sapiens
MFSDVHFCNNHSGCFCMWGVCADVCCVCSDVCWVSADGVLGVHCGCAGCVLMCAGVLGVLMCADVGTGVRGVCGCVRGAVMLRWERGCGAGVSADVCCVCCVFQRVCASGC

SEQ ID NO: 783291 - protein, 282 aa, Homo sapiens
SSLKATAIDQISISACSQAETSYGLGKFETRPSEFAEKTTNGHKTDPDCKLSDSCGSISKADHSGSLDPTNKGDAREKKPASPQVVKEKESTGTDTSDAKTLLLNPKSQESGGTESAANPTPSPIRKNQESTLEENRQTKTATSLSLPSDPMGDSSPGSGKKTPSRSVKASPRRPSRVSEFLKEQKLNVTAAAAQVGLTPGDKKKQLGADSKLQLKQSKRVRDVVWDEQGMTWEVYGASLDAESLGIAIQNHLQRQIREHEKLIKTQNSQTRRSISSDTSSN

SEQ ID NO: 783292 - protein, 125 aa, Homo sapiens
PSSLHCAQGFPFPVGLQPLSSHASSPWPFSLPAAHSTPGCASVLSYQQLYLLSSTSSSLSSPFPEASLLSSSLPAFGILFFSLISFVSFFCSFKLSLSRPCRQGWPMTRGQPVTFMACSTSDTSS

SEQ ID NO: 783293 - protein, 124 aa, Homo sapiens
MRKLIAGLIFLKIWTCIVRTSTDLPQTEGCFQYIHQVTEVGQKIATVLLFYSYYECLGTPKGTCLYNNTQYKVCNPGSDQPDVCYDPFEPPMITVFEVGLRTGHSLSDTSKVIARTEEKGVPKM

SEQ ID NO: 783294 - protein, 195 aa, Homo sapiens
GQRVSCGMGPMPGCSWLIPGPAKMLLAHTWPWEDAPGSHLALGGCSWLTPGRGWWSRLTPGCECWSRLTPGHGWWFKFTADRGWWSRLTPGPGWWSRLTHDPVRMTLAYTWPWEDDPGSHLAMGGGLDPQLAVSGGSGSYLGSGCWSRLTPGPGWWSRLTPGRGCWSRLTPGRGCWSRLTPGRGCWSRLTPGPGC

SEQ ID NO: 783295 - protein, 123 aa, Homo sapiens
RVFGYVTGALRFLELGSLLVRVGTGKSDLPARSCVLPAEEMMIIPHLLRDKDQRATTATSPRTRQCWGMENEGVQLWPSQSSGGDETHLPLSLWAHLMPGASVDRGHAPGLPKLEKAARLRPT

SEQ ID NO: 783296 - protein, 107 aa, Homo sapiens
RVMRLQTQGLEHCSFSSSWWGIMGWKCTLPVGSHPTTHQRYIPSRLHIYYLPGPGGILLCILDWESQGLRTNVLPPGSRRVRSEYSRSGISGDVAAPSSLHLRGTAT

SEQ ID NO: 783297 - protein, 70 aa, Homo sapiens
RVYSLDVLSHHAVIEAAGEKCPSSLRLNFLKAAAERVPPPSPSCVVSLLHTHTAESRAVVLSEHHPLLDD

SEQ ID NO: 783298 - protein, 112 aa, Homo sapiens
CLPLPTPSVYSFQQHWPSFFQQSELKTSDFLFLYLAVSSKRHSLPDPLMESSPVPVSHFLIYCFVADNCKKLFIYYLSSHPQRRMSARYVQGQCQSLCAYYTAKNLPQRKTL

SEQ ID NO: 783299 - protein, 82 aa, Homo sapiens
MSQEHAIALHPGRQIKTLSQKKQNKQTPREFLAQASDPHHHYHQGIFCCSPKSSLHPLNSWGNATRLSPSPFREFASSQSCS

SEQ ID NO: 783300 - protein, 86 aa, Homo sapiens
ANAYKKQPIIKLLFLFWFTELEDHRTLGSEGTLAVIESNFGHFKDVAASLKVDLNNESLNALSPSHESTPHHTRVGGTEMKAMPRN

SEQ ID NO: 783301 - protein, 106 aa, Homo sapiens
ASASQVAGTTGARHHARLSFVFLVEMGFHCVGQKNPWIHGGSHGRHSWAAALPSGEEPQDGRWPLQGPAVAKDLGVLRLFLQHLGTVFDSGFRERELGPREENLLI

SEQ ID NO: 783302 - protein, 67 aa, Homo sapiens
KAHNLSQPLLCSPGHCFAESFYYAAPQTQSPAATCPQRHRGPANCKHGTSGSCFSGYFHYCNFFVLR

SEQ ID NO: 783303 - protein, 107 aa, Homo sapiens
LESKGRDVLLRGLLVSQEKNLWLLLVLSDAKTLLSQRSCYRHRASTHGHSRQWAIEYKRPRCPEVKVDCVFPSLRLLCLQHAPEGSEAHPPRGFFCLFVCFCCCCCF

SEQ ID NO: 783304 - protein, 122 aa, Homo sapiens
DQNCFHAAGLIYCEGVGLLQDWFPRLSGTPGLWPGGSLEPQCKEDPSPTPGRATPTHVHTHTHTPHRHRQAYSHLCSHTHSYPHKGTGRRSHTPCAHTHSYPHIGTGRLYSHPCAHTLIPLT

SEQ ID NO: 783305 - protein, 71 aa, Homo sapiens
ALSNTNKNLRAWAWLSGMVLTWGWFLGLGCSRGSLEAGSGLAARKPCTRANRPRASCLLLVTLRPHMSVFL

SEQ ID NO: 783306 - protein, 103 aa, Homo sapiens
LAERGWKQASTNQQPAPRPPRREQAGSGRSETNKRDGGREGPGRCGPGLGFAAFNPSHSAAGNPRRTSPRGLSSGLTLRGWGSGSASRPPADSPEAAGPPRPQ

SEQ ID NO: 783307 - protein, 57 aa, Homo sapiens
MVGLPQMRKPGERIWGHQRKLQRPLGVHLQPGTADPDLTVRIPGSVPPPLGPPLLGP

SEQ ID NO: 783308 - protein, 52 aa, Homo sapiens
MCTYENNFKIVRSHANVRMLMMMAEEEQQKENGEKEEEEGKGSNSRPLVCVQ

SEQ ID NO: 783309 - protein, 44 aa, Homo sapiens
TYIDKKCPFTGDVSIRGRILSGVVTKMKTQRTTVIRRDYLHYIR

SEQ ID NO: 783310 - protein, 124 aa, Homo sapiens
MLVVLATWEAEARESLELRKQKLQRANFWSSSALQTGKQSKTLSRKKKKERKRKKGRKRKKGRKEERKEGRRGRRRRRRRRRRRRRRRRRRRRKRRRRRRREGRKEGRKEGRKEGKKEGTSRDC

SEQ ID NO: 783311 - protein, 107 aa, Homo sapiens
SRRKSSCAKLWNKRAWPEETTTAKALGQKELDMMEDRKERSLQPQKRVWFYSKCPWACLLNTHSVFKAQFHAASPMKPSLNACLALPCQPLGPSGSHPTLALSPLLS

SEQ ID NO: 783312 - protein, 56 aa, Homo sapiens
HSWLVTSGSPARSRRKKGVQTGEVIPGPPGNSCSTLRKPVRKLPSLRKPSSMNSRM

SEQ ID NO: 783313 - protein, 39 aa, Homo sapiens
HFLVDTQNNNKDSLPLKPALPSSFLTPCWTPTAGKESST

SEQ ID NO: 783314 - protein, 264 aa, Homo sapiens
MAEEKKLKLSNTWCLALRSSMKGGGVISQWRIATEFRERDLRRLLEQDEVSYRIERRIAQDAIEVHAHGERGQKLTTSDIDYALKLKNVEPLYGFHAQEFIPFRFASGGGRELYFYEEKEVDLSDIINSPTAPGDPGRLPQSSLAEHRGLQPAIPENPPPGPKEQQKAAATEALKAGKAGRRKRTLKGKVRGNTADARTRDGRPAEGPWTGPRGHNRCEASDSRNARRGTGAGGAAESSQEDEGGDSEGGRGTGKRGNRTKRQA

SEQ ID NO: 783315 - protein, 242 aa, Homo sapiens
MAEEKKLKLSNTWCLALRSSMKGGGVISSGAIATEFRERDLRRLLEQDEVSYRIERRIAQDAIEVHAHGERGQKLTTSDIDYALKLKNVEPLYGFHAQEFIPFRFASGGGRELYFYEEKELMAEHRGLQPAIPENPPPGPKEQQKAAATEALKAGKAGRRKRTLKGKVRGNTADAGRETGDQQRGPGHDPEVTIAARRATAGMRGGGQEPGERQSRARRTRGETAKADEAQANGETEPRDKR

SEQ ID NO: 783316 - protein, 592 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTGKCWVLASHPPLAEFSLTHSFKNLFALSSFLP

SEQ ID NO: 783317 - protein, 1008 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSEMGFPHAAQANVELLGSSDLLTKASQSAGITASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 783318 - protein, 281 aa, Homo sapiens
MSPLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 783319 - protein, 608 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTPG

SEQ ID NO: 783320 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 783321 - protein, 759 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 783322 - protein, 238 aa, Homo sapiens
MVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 783323 - protein, 150 aa, Homo sapiens [sequence omitted]

SEQ ID NO: 783324 - protein, 126 aa, Homo sapiens
MLFLLTPSSHHQHECVRRAFECGDCHILLDNNVLGVDCHGAGERAVHLDCRGADPGSTTGPSLTQADRFLLVFRVCFCLAPFEIGYDVGGKAAASKPHANSGQQQPVVSWKMDGQRIGKEDHAFPY

SEQ ID NO: 783325 - protein, 45 aa, Homo sapiens
GICSYLSQAPQSLSGYADDGDRLKLKLQEELFAAFKQPRPGTGSD

SEQ ID NO: 783326 - protein, 160 aa, Homo sapiens
NVAKVLITNQALHIIIDFILERNLTSVMNVARFLGHSHNLHVIIDFILERNLTNVKNVTKFSISNHTLKYIGEFILERNHTNVGFATRLLGVIHTLHNIREFTLERNHTNVRFVTRLSSVTHTWHNILEFILERNLSSVVSVAKPFVHSQHLFTIRQSMV

SEQ ID NO: 783327 - protein, 162 aa, Homo sapiens
ATRPDMIRILSAALHVVLRRDMSLNRRLYAWLLGPRSTRHSNPEEHATYYFTTFSKELLVQAMVGILQVNGFGEENTLMQDLKPFRILISLLDKPELGPVILEDVLLQVSSPIIILNAQAAAWISHNCNHPSARILLRSAGGFLPNNSTVDMKTNHYRLTSI

SEQ ID NO: 783328 - protein, 95 aa, Homo sapiens
TSDHVSSRPIPVRSSGSAAVGNSLQTHWCCSKGGSREQGNGCVFWASWPHSLLTSRDHGSSMCVSETSSTDGNVPCPVQQPQGTQGSRALEKRMV

SEQ ID NO: 783329 - protein, 30 aa, Homo sapiens
QAEQKGYLNTARREASLAFKVTETTHNKSG

SEQ ID NO: 783330 - protein, 111 aa, Homo sapiens
VFVVSWLDMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 783331 - protein, 86 aa, Homo sapiens
NGCSQLGPQSHGKSLCYYVDSTVHGLRALTVELFRPGFNNTHFVNLGKFLTSLSLISTIKWDKDIAAALENGLKTRGNLYLVHCKP

SEQ ID NO: 783332 - protein, 104 aa, Homo sapiens
VDFSSRGTVGPELCRAVLPIRWGCSDLSNPWSAGFSRGPQPGCVCLQCSLRCPGGLNLSTCTGRQRLTRPPAGRPLGPASARLLLPPLQLTQPRTTRHTSLLAL

SEQ ID NO: 783333 - protein, 101 aa, Homo sapiens
MGLPRDPATPLLGIQAIEKKTIDQKDTCPHMFTVALSTTACVWNQPTCPSPNEWTKNCGTQTQWNTIHRIKELNPVIRGHVDQSDRCYVKCRHRKINTAHS

SEQ ID NO: 783334 - protein, 75 aa, Homo sapiens
MNYVGQLAETVFGTVKELYRGLNPATLSGGIDVLVVKQVDGSFRCSPFHVRFGKLGVLRSREKVVSAQVAEVATA

SEQ ID NO: 783335 - protein, 90 aa, Homo sapiens
GSGGCSQPSEQSGRKLPGGPGNHFWAPSTYPHLTVDSDSGTPWSGLQPMPWLLRLALFAPGFCSRSPPVFALHRVDLEFTEVMRWGMPAH

SEQ ID NO: 783336 - protein, 109 aa, Homo sapiens
NSWCEVGPYHIELSVSFSHSMHESLTRLYLFSIAALTHYQKLSGLKQQKRIIFLFCRSEVQYDSNQANIKVSVGLQDFWRFSPFLVYSDYGRIQFFGFVGLTFLFPHWL

SEQ ID NO: 783337 - protein, 114 aa, Homo sapiens
MWPFFCFFFPGGLELEIYISLSLSLPTIPLSFSSSPTLPQDRKGHIFYKQGALSLVPFPSAQMKRIFHLTGEVKSETQTGANLSKWGGSTSPTCTAIWNQHLSRNKMLFCFADS

SEQ ID NO: 783338 - protein, 69 aa, Homo sapiens
MQLGVCVSTDTSKNTNTQMNTDWGMWALLFNQSLQPGLLPRSVPFSYDICSLNHGLLPRPCSPGPSSRH

SEQ ID NO: 783339 - protein, 88 aa, Homo sapiens
SGRGRPGSQPHSAGPAQWQRARPLQGLSHVASWKRQLWEQASEQWLPGAVGQGRKSTPKGPKGVFRAVGTYLSCAAVYTTAYTGEGYT

SEQ ID NO: 783340 - protein, 114 aa, Homo sapiens
RECALPGGDQGCTGSISFLGIGEAGPGPSLPSLFPTRGAGRGESPGPGSLCVVWSGDIMWHGDARLRVLAFFPRDLFFFFFGDEVSLCRPSWSCSELRLHHCTPAWVTRVKLRH

SEQ ID NO: 783341 - protein, 79 aa, Homo sapiens
MSILESRTGTSTLSTDPSPASMGDPAQRGTENGHLPADMVARGDKRHNRDSRKPSRAQGRQERVQRGGDSGQGLAWEWG

SEQ ID NO: 783342 - protein, 69 aa, Homo sapiens
ACGDKTTVRGIAKNNSGLSGLGKWMKAEAPFTNGRRVVLVGKTISPIFGHADACGFSRWKSLKGSWIHG

SEQ ID NO: 783343 - protein, 103 aa, Homo sapiens
RWESGLGERARARASAGRGGPGHVMYRHPRYRLAAGVTSPPLTAGGGTSAPSPAAPQPLAPPAGALSQFEWAEGERGFPSGPSPTASPAARSPRPGTGMGAAA

SEQ ID NO: 783344 - protein, 130 aa, Homo sapiens
LETLYHLDFYDDMLSWSPATTRTLTLSPFTASTSLHGHSILSSFLSKPSDIEISHTPKALTITFVRMIPKPVALPFLSHSIPKFSCLPYVSPWRLHSPLKLNGLVIITVKINSCPAPQKKPLSSFSLFSV

SEQ ID NO: 783345 - protein, 104 aa, Homo sapiens
MLPPGHYLLGPALHPVAGLTVITPTVQGGLRDLLSSLPRTGSRMFPCGRLVWPKWTLACCPLGRLQALPSTWGSSILCLTMLCHAGPSPAPQPCCFSPPHPRHL

SEQ ID NO: 783346 - protein, 144 aa, Homo sapiens
WKSLDWSEVGEYVQTQRKTWAQEIYERRDGRAGSGREKSGPQSPSLLSQSQLCSSSGTLHQEPGPGLCSCTVWSQHSLGQSGRVCRLESQGRENKVLVKRAWGGSLASLCRRQAVCQARHALHLFTCPSAHPSTHPSIYSWSRC

SEQ ID NO: 783347 - protein, 112 aa, Homo sapiens
SSHSWAAEFLEWAPCSSFFLHSNQPGLIFRISLFSPGLSFLIFKIRRAIWAGTGEALSCLGHLPHQNSHHGPSVTSQPPPMPGQIPPACQRPHGHLLCQDRDHQPINGPTAT

SEQ ID NO: 783348 - protein, 89 aa, Homo sapiens
MAPQRGYAAWDQARTRAQENTTQSVIEATTSCTTRGNKACSVQGLLGRVSAPSKAASAKPAFLHAHPRSHPAGTWHSPPWPGPEPGLQI

SEQ ID NO: 783349 - protein, 105 aa, Homo sapiens
LCSHLSFPLGPHGTEALCYALLPCLCFQLASEGLAFTVIQSLAVGQARAVTASRMFSSGAPPAQVLGLCEPLASRGGHHTTSISPVQANIPFLGYPPSEAQSQAP

SEQ ID NO: 783350 - protein, 97 aa, Homo sapiens
WDGGLQPQPQPQPRTAGGVGAAVWPPRPHSQLMTLLPQGFLDYPASYLHSHKTTRAELIRLNQSPTLLNNPNFFFPFSAAPCAIYRRLFSLWHQCIF

SEQ ID NO: 783351 - protein, 65 aa, Homo sapiens
MSLTHVFSSPRAGARYPPVTPSHIFQTGTSKPCPGHVSKPASLLQAHVMPSLLRAPRSRRESVGT

SEQ ID NO: 783352 - protein, 98 aa, Homo sapiens
TGDAVGIRCTDIDECVTSSCEGHCVNTEGGFVCECGPGMQLSADRHSCQDTDECLGTPCQQRCKNSIGSYKCSCRTGFHLHGNRHSCVDTPQGFLSAH

SEQ ID NO: 783353 - protein, 84 aa, Homo sapiens
GPGDWFDQVCHLHSSRKDWPSYPNLLLCKYSYYQVVASTPAQMALLVLRHDPDTRGNKEKGAGIAILNVPGFQVQLLAFTYASL

SEQ ID NO: 783354 - protein, 67 aa, Homo sapiens
GAGNCPLSEPPPPRLRIISVKGACDGVAGRAVTPTPQTLVLLLGRVQLVITADNPAAAIHTDIPLKL

SEQ ID NO: 783355 - protein, 71 aa, Homo sapiens
GCYKITRRMMEIGNETIPSALVRSRSGGRHRVTRSTQLPGTGLQEKEHRDWGQMYGGCYILAEKFSCDDLA

SEQ ID NO: 783356 - protein, 68 aa, Homo sapiens
STLPILVQASQITAVAMDLPPSFILVPQLSAEELSGVVRKMHLKLRSDYIIYLLNILRWFPMLFKVMV

SEQ ID NO: 783357 - protein, 104 aa, Homo sapiens
GTQALPFCGTNLLLHPAASREKKAKNGPLQTCSGVERHSVHLLGAQSWGSASCQEAMEQCFWPTLSRPLLPCANAESGCLIFWALWTNFRWPTVGHRSFSCPPP

SEQ ID NO: 783358 - protein, 121 aa, Homo sapiens
TERDLLFHLLDELSKTSDFEGYILKLRKSVTRRQHNYSTVPQESRHFQLRPELELVKKKLLAEVVQGQSRSPRISTPHYRRGNKRRFCRGKSGNSTEAIIIPNANRATKGQETKSGPMQSG

SEQ ID NO: 783359 - protein, 106 aa, Homo sapiens
VQWDHTRGPHNNSVSSRNALQPPSGGGFFCFCLSLYRDSFALLPRLEGLDRLSSSNPPASALRIAGTIDMHHHTYPIFLLFVDTESRYVAQAGLKLLGLSTLHASA

SEQ ID NO: 783360 - protein, 117 aa, Homo sapiens
ACGCACAETGVCGHVCAETGALDSMRVCRDGCVWTRVCAETGVCGHVRVQRRVCVDVRVQRRVCGHLCVQRRVRVTPCMCAETGACGHACVQRWMCVDTHVQRRVRVDTCVCRDGCA

SEQ ID NO: 783361 - protein, 190 aa, Homo sapiens
KKAAKPKEKCEKGLAAYRAKGKPDAAKKGVVKAEKKQEKEEEAEENEEGEEGEDKEMKMKKTMIMNKLVLVFFFLVCKAFSPPVHNSLLFSKHNKQWTYGQALVVNIGCSSTPITFSSFLGYQLTTYYRKRFLLDTPIRLGGAILFPLVIISGRLGVSIGSTQVLECNGTILAHSILCLLGSSDFPASAS

SEQ ID NO: 783362 - protein, 68 aa, Homo sapiens
PQEAIGPWLYGPQTLDKAKYIVLKYQTPMPPESTPGPGSNVDGCWSFILWPLWLISWRFPYSYGKYCQ

SEQ ID NO: 783363 - protein, 104 aa, Homo sapiens
SAPISPGEWRLLWSGAKIGRPRREKGLQSTSQSTRCYNKNIANCHSAFITVPDEETGAEPWSNLRRVSSRKTGPWSDEFTHFGHQGRCWHSLNSRPALSNGNRT

SEQ ID NO: 783364 - protein, 109 aa, Homo sapiens
YFSHPPQEITQWTFPSFFLFSAVGPIGPREGCPGSPLSSSVGQLRRVLFFLAWLTSAVSPQISTTQNAPHIRRVSACVCCVCALRVCVCCVWDLHIGGSLRKACLLTWD

SEQ ID NO: 783365 - protein, 130 aa, Homo sapiens
QWESSETRFLGLELSLNSQSYVQSNWSGADSKAGNTIVVRTRPQVKWLQQSTLSPRKTPERGRVKGPSQCSLDGGFPVPNHPANLPMLHYKQPWGPEVTMILSSVLKSWCLKLKLFSLWWPHYLPTAELR

SEQ ID NO: 783366 - protein, 118 aa, Homo sapiens
TVPGTLPTQGLCSLPGRNALPPELPSHLLTRFLSLLRCHFLNETFHGHLFIIEKNKCIPFLPFPVLFFSLALSILDHNTCCFLIMFFVCFCPLECDLQRGRGVVCFVHCCVPCTEHGA

SEQ ID NO: 783367 - protein, 142 aa, Homo sapiens
MDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIY

SEQ ID NO: 783368 - protein, 45 aa, Homo sapiens
SGIMPSACRGVGCGNHLWTGHPAIQEIRSVQPWDPVVPLYPRSHY

SEQ ID NO: 783369 - protein, 127 aa, Homo sapiens
LTLRIEVVNRKFGRIKVLRSRIRFIHLVTGCVLGSSGKVLPKWGWEQLEVTCTPYLKETLNSIWNVEARSRRRAQNPVKVSWLDGSENPPPVQPPSPTHCLPVCLPAGLGPLTRPPACVALLQFSSP

SEQ ID NO: 783370 - protein, 40 aa, Homo sapiens
MSRGDEDCHTHPIKGGPSRPPGAFSLPWHLEDPDTHDPGP

SEQ ID NO: 783371 - protein, 48 aa, Homo sapiens
MGGTGTRWVLYHPKSKGRPKRGAAVPCRASMAVGQGPRQRRGSWTGRP

SEQ ID NO: 783372 - protein, 67 aa, Homo sapiens
MAMPTGDMALSPPEFWGSVEQTDLLLVGTVPLGHCRHLSSQQVSCHSFACEVFTSSSSSSSRQTRPI

SEQ ID NO: 783373 - protein, 199 aa, Homo sapiens
SVTCSCGNKDIFYCAHVVALSLYRIRKPDQVKLHLPISETLFQMNRDQLQKFVQYLITVHHTEVLPTAQKLADEILSQNSEINQVHGAPDPTAGASIDDENCWHLDEEQVQEQVKLFLSQGGYHGSGKQLNLLFAKVREMLKMRDSNGARMLTLITEQFMADPRLSLWRQQGTAMTDKYRQLWDELGALWMCIVLNPHW

SEQ ID NO: 783374 - protein, 122 aa, Homo sapiens
ILTGRARAVSKGGGREVARGGVSTRTRPGVSEEGMTSRRFAKGKPEGYELLGSEMGLSARVFPCRAESPKSPRRQGGQWAWSFPGRQRESRDGTSSSPLTKSVCMAVSPILYLPGLRKSRGD

SEQ ID NO: 783375 - protein, 61 aa, Homo sapiens
SVVKNNIQENITEIKVDLDLHIERAHQVLKTDPEKINTISTLVDTGHKKEFFGHSGKKTKS

SEQ ID NO: 783376 - protein, 110 aa, Homo sapiens
MAGTICSRALNPSRGNPGLGRVHPVPHIFADLCAWQKASVPAACCHVQKHLPLDGTVAPQMTVTSFPSLPLPLSFSICCEQNKTKTHTQSEETKKETGQRAPTSSTAGLP

SEQ ID NO: 783377 - protein, 94 aa, Homo sapiens
GPGPGLRVVTASRGKSLFLPFPPDQPSVFPLWRGSEWEGRTHRCAAAMARILAEHLCWCGGTPSSHFQTSLPMLLPHQGTVPTPSSFEGHYPSS

SEQ ID NO: 783378 - protein, 103 aa, Homo sapiens
APPGVLAMAGGDQTTCRWYRGKLRPRGCRRCAHPYTASPPWPQQLPCSPGPTCRTRILGCRWPRPGSECRVDSWRPQEPPAWPPTQPRQHPSPPLIITLEIFD

SEQ ID NO: 783379 - protein, 103 aa, Homo sapiens
MLAHTQWHTCQRLSQLTHRSILKYLLIDTHACQVLILKHTHASLSLPSCQECFPSSIPSASHLVSHPHPPPSPRWGQTPEGLPAASPCGPGPRSCFSSILPTG

SEQ ID NO: 783380 - protein, 110 aa, Homo sapiens
MWPWYIRKMKGVFSKGVVEVDEPIHVRKGVSLGTVGRLGKEESGLVWRTVGFRIGRVGGIGVRVGVYIVEDNSLMESKQMVVREGWKGGKPQPRMAEEEDKKFLGPLWNP

SEQ ID NO: 783381 - protein, 80 aa, Homo sapiens
LCQGFSRDAEPLSVRNKGVIAGVRLCVMEGGGAGGKVRRRVPGKVPEEPGEVLTGVEDTQGLWGHLLLLGASHKGNWPKS

SEQ ID NO: 783382 - protein, 144 aa, Homo sapiens
TRCEYFLVDPARHPASRQAQVCTDDRTQHMCTHTLPGKKVVLGAQWRRQAGISLHGFWPWLHRASCVTLDKGFFGKPQFRRTSLWGCQQPGGDSGAAFPCWAEAGSPVLATRPLSPPVETCLRLPCPGPHRLHRDAGPRPLFWQ

SEQ ID NO: 783383 - protein, 123 aa, Homo sapiens
LTSATASHLTCCTPAANSQHCHEKDTVKTEVTFRHSSAQNLPVVPLGEAYETITPLQLSWLPHALLLLLPQDCSHTLPTPLPMCPSLSTPAITHKFRLFCSLLHPPDHSMEQVPCTCRMNRQK

SEQ ID NO: 783384 - protein, 105 aa, Homo sapiens
HLSPGSCTLSFSLTRPSNCALNKGKALLLVYIYEKQSRTLGGEGGNEMEPLELELAQLQVKPPSGYSEVRTVTREAKKAMFQLRKNPLWHPQSKAVSPILLSPQL

SEQ ID NO: 783385 - protein, 36 aa, Homo sapiens
MEIVRGQGALAGLLTSQTPGLESDLNQQPSIPSAPV

SEQ ID NO: 783386 - protein, 72 aa, Homo sapiens
AETPHAKWEERHCTASGGLSVSMQQECTGMFALCPGNPTSRTLSRNTPTKTGNVLSIQPLLAALSVTANARE

SEQ ID NO: 783387 - protein, 68 aa, Homo sapiens
THTQMDTRAGTPGSTDPGMDIQPGHKHPEQLVAHAHGLGGDPHLGTQPTHTHTCTQPLRWARDSAQTH

SEQ ID NO: 783388 - protein, 176 aa, Homo sapiens
RPQVRLSSSCSSLAFMSHFSLKRWKSLSFPQARISIYQNMAGRGRQRHHGGQQVPSHSGGSWPVQPPAISTVPSPFSRCFSGGRPSALSLEALFMGPAPLRGSPALPLLQSQKEKAQRARPTWKSYKTAEGQESWKFQAILSQGKRLSPCHFKKASCLHIKVSSLSWDPIDHTGLL

SEQ ID NO: 783389 - protein, 142 aa, Homo sapiens
MCLQTLPNVLLRTDSLRTYGNKPNSLRTYGNKPNSLRTYGNKPNSLRTYGNKPNSLRTYGNKPNSLRTYGNKPNSLRTYGNKPNSLRTYGNKPNSLRTYGNKLNSLRTYGNKRNSLRTYTHTQIHTHKHSAHTCTHTQTDTP

SEQ ID NO: 783390 - protein, 895 aa, Homo sapiens
PKEKQLKNEELVIFSFHENNCKIQEFHVDGKELIPFTEMTNASEKKSSPFKDLMTVPESRDEEMSNSTSVIYSNLTREQAPDISPKSDTLTDSQIDRDLHKLSLLAQASVITFPSDSPQNSSQLQRKVKEDKRCFTANQNNVGDTSRGQVIIISDSDDDDDERILSLEKLTKQDKICLEREHPEQHVSTVNSKEEKNPVKEEKTETLFQFEESDSQCFEFESSSEVFSVWQDHPDDNNSVQDGEKKCLAPIANTTNGQGCTDYVSEVVKKGAEGIEEHTRPRSISVEEFCEIEVKKPKRKRSEKPMAEDPVRPSSSVRNEGQSDTNKRDLVGNDFKSIDRRTSTPNSRIQRATTVSQKKSSKLCTCTEPIRKVPVSKTPKKTHSDAKKGQNRSSNYLSCRTTPAIVPPKKFRQCPEPTSTAEKLGLKKGPRKAYELSQRSLDYVAQLRDHGKTVGVVDTRKKTKLISPQNLSVRNNKKLLTSQELQMQRQIRPKSQKNRRRLSDCESTDVKRAGSHTAQNSDIFVPESDRSDYNCTGGTEVLANSNRKQLIKCMPSEPETIKAKHGSPATDDACPLNQCDSVVLNGTVPTNEVIVSTSEDPLGGGDPTARHIEMAALKEGEPDSSSDAEEDNLFLTQNDPEDMDLCSQMENDNYKLIELIHGKDTVEVEEDSVSRPQLESLSGTKCKYKDCLETTKNQGEYCPKHSEVKAADEDVFRKPGLPPPASKPLRPTTKIFSSKSTSRIAGLSKSLETSSALSPSLKNKSKGIQSILKVPQPVPLIAQKPVGEMKNSCNVLHPQSPNNSNRQGCKVPFGESKYFPSSSPVNILLSSQSVSDTFVKEVLKWKYEMFLNFGQCGPPASLCQSISRPVPVRFHNYGDYFNVFFPLMVLNTFET

SEQ ID NO: 783391 - protein, 356 aa, Homo sapiens
MNTWRRPWSTCARYSGSAKRSLGSSHSPWASPRMRMENSSSPTASWVRTDSSLRPWGGTSSQDRWRLCVPGMTSSAASVATTSQNLGGRPHPRPQAQPALPGQLPDAGLAAAGLLRGLSVLRRAPPMHAAAHPGLRPLRLCHDTADRAGEAAPALKVAAAFRAGWRDLPHSPTLGLRGPGKPLQEGTRSSSGFWSGVPAAAEASGGNTTKKGRQLGPSKGVATRAQQPRSVTAQSSAPAFPSLCQGLMAKPALGAFFPVPIWLLCCTKLGSQPAKSRLGLASPLAGLEVGRVGCGASSLCVGPGRWLKSPLQERIKVSRVVRKPESGSPDSSLWGAFFMFSQLFQDWAVEFHVSGA

SEQ ID NO: 783392 - protein, 374 aa, Homo sapiens
RKTDEYLEKALEYLRQIFRLSEAQLRQFTLALGITQDENGKQQLPDCVVGENGLILTPLGRYQFAGQMAALCSRDDFLGSFCRYHLTEPGLASRHLLSPVGRRQVAGHTRGPRLSLRFLGSYRTLVSLLLAFFVASLFCVGPLPCMLLLTLGYVLLRLCHDTADRAGEAAPALKVAAAFRAGWRDLPHSPTLGLRGPGKPLQEGTRSSSGFWSGVPAAAEASGGNTTKKGRQLGPSKGVATRAQQPRSVTAQSSAPAFPSLCQGLMAKPALGAFFPVPIWLLCCTKLGSQPAKSRLGLASPLAGLEVGRVGCGASSLCVGPGRWLKSPLQERIKVSRVVRKPESGSPDSSLWGAFFMFSQLFQDWAVEFHVSGA

SEQ ID NO: 783393 - protein, 172 aa, Homo sapiens
RKTDEYLEKALEYLRQIFRLSEAQLRQFTLALGITQDENGKQQLPDCVVGENGLILTPLGRYQFAGQMAALCSRDDFLGSFCRYHLTEPGLASRHLLSPVGRRQVAGHTRGPRLSLRFLGSYRTLVSLLLAFFVASLFCVGPLPCMLLLTLGYVLYASAMILLTERGKLHQP

SEQ ID NO: 783394 - protein, 103 aa, Homo sapiens
RSRGSRHVVRTVGRWGRILPVSALQPKMVRSIVTSVTSSAQRHGNRSVVLKYSKYTTTDSLTETSTGSSPSFTPQATCEGEQHLSGDFQTKPLFSVWGFGGLL

SEQ ID NO: 783395 - protein, 374 aa, Homo sapiens; identical to SEQ ID NO: 783392

SEQ ID NO: 783396 - protein, 374 aa, Homo sapiens; identical to SEQ ID NO: 783392

SEQ ID NO: 783397 - protein, 331 aa, Homo sapiens
EEKGVRPSEQKGKLLRSARCRGLADDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAA

SEQ ID NO: 783398 - protein, 389 aa, Homo sapiens
LSTRCVVVLLSAELVQHFHKPALLPLLQRAFHPPHRVVRLLCGVRDSEEFLDFFPDWAHWQELTCDDEPETYVAAVKKAISEDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKKSHKEELMHGEEADAVYESMAHLSTDLLMKCSLNPGCDEDLYESMAAF

SEQ ID NO: 783399 - protein, 56 aa, Homo sapiens
MATHGPIITYLLPSEPIKTSGLSQTHTDVRTTSGGKELPTSVLLDLLGKPNCDKEL

SEQ ID NO: 783400 - protein, 126 aa, Homo sapiens
SVHAQFGPMHMHTGASDRDPPYLKGQSWGSPGKGLSLSPLRGQGRKGSRRVLCPRLPPRCTGTSIVILRPAVCTGREPGASDATWGPHSSPGSSCSHRLENTGFRPGTAARFCHPSTLGCRGGWIT

SEQ ID NO: 783401 - protein, 42 aa, Homo sapiens
VQQPVCRPCAYECVRDPVNPRPASCATPKPVAFPGCAICRCV

SEQ ID NO: 783402 - protein, 69 aa, Homo sapiens
MCSSRHCGSSCNIITPTSVVANVETAGRQAGLSFQLRGKSHCGARIPPGGQGGREGLSESAAPSVSHGA

SEQ ID NO: 783403 - protein, 81 aa, Homo sapiens
RWYDVRVEIKMSEMPKQGMTKDRVLKPTRVEKGMYMGEHPDVTGQSLSELIHGMRVEPTQHRVLESKQSKEDICMKKGLQQ

SEQ ID NO: 783404 - protein, 109 aa, Homo sapiens
SLFIVDHQLEFSLKERIYYKNSEIPCGMWQWEWSWLTGMDGLENHQDPVHVLIGASASVSAQFLPFLHCLPSMDSPWKSPAFSNSIGSFKSHWLVLHKLIQYWIVRQQL

SEQ ID NO: 783405 - protein, 56 aa, Homo sapiens
CPASLQLNSFEQLCINYTNEKLQQLFNHTMFVLEQEEYQREGIPWTFLDFGLDLQP

SEQ ID NO: 783406 - protein, 64 aa, Homo sapiens
MYSSATCVASTYLPELWRGFKVQTQVNTGQCQECNQHLMNPRVMIIMLMFYLSMQGVHGILAPV

SEQ ID NO: 783407 - protein, 74 aa, Homo sapiens
FTDGRQIAAPEDSSKVTAGRESVTSVPGTTGFSGCSETIVTVFGTDVTSGFRSLKQNRLHNSIEIYSQNSNNRL

SEQ ID NO: 783408 - protein, 103 aa, Homo sapiens
NATAHVVLGKLKTLGYSEGHGDPAYPVGQGAGSEGGKGQESPERRQKGGVTAYSGQELLGLVHRTQQPLPEIPFNKGSPAELPWRPGKEEPTVAPTPPGQPIP

SEQ ID NO: 783409 - protein, 104 aa, Homo sapiens
LSTEIILHVEKLNFGWLVWRQSLLPVSRLECSGTISAHCNLCLLFSSDPSASASQSAGITGVSHCTPPRNTLKSLKKELSAIKKYTKGERYTIAYEMSQLSHDH

SEQ ID NO: 783410 - protein, 247 aa, Homo sapiens
QHNVRQGPAVPPSIQAYGAAPFGDLQVDFREMPKCGDLIPRFRLPLRIGSHNGPAFLAAMVQKTAKVSKSHRATESHRSLRTPPPGLSEDPELQPILAGLSLSMYLVTVLRNLLISLAVSSDSHLHTPMCFFLSNLCWADIGFTSATVPKMIVDMRSHSGVISYADCLTRMSFLVLFACVEDMLLTVMAYDCFVAICRPLHYPVIVNPHLCVFLVSVSFSLACWIPSCAVGLCCNSPSSRMWKSLIL

SEQ ID NO: 783411 - protein, 266 aa, Homo sapiens
QHNVRQGPAVPPSIQAYGAAPFGDLQVDFREMPKCGDLIPRFRLPLRIGSHNGPAFLAAMVQKTAKVLGITRKLHAASQPQSSGKVSKSHRATESHRSLRTPPPGLSEDPELQPILAGLSLSMYLVTVLRNLLISLAVSSDSHLHTPMCFFLSNLCWADIGFTSATVPKMIVDMRSHSGVISYADCLTRMSFLVLFACVEDMLLTVMAYDCFVAICRPLHYPVIVNPHLCVFLVSVSFSLACWIPSCAVGLCCNSPSSRMWKSLIL

SEQ ID NO: 783412 - protein, 86 aa, Homo sapiens
ASSGAQVQTCPIGEKEKGRAFWLKEHVIKAVEAWKGTALMCLEMKISPGGGVQEPALCRCGSECHAKVPGTHPGGRRKPLHFFQER

SEQ ID NO: 783413 - protein, 390 aa, Homo sapiens
MASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLSSWCIQIYLYY

SEQ ID NO: 783414 - protein, 265 aa, Homo sapiens
MTVDSSMSSGYCSLDEELEDCFFTAKTTFFRNAQSKHLSKNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLTILEKEEQDKIQQVQKKYDKFRQKLEEALRESQGKPG

SEQ ID NO: 783415 - protein, 265 aa, Homo sapiens; identical to SEQ ID NO: 783414

SEQ ID NO: 783416 - protein, 265 aa, Homo sapiens; identical to SEQ ID NO: 783414

SEQ ID NO: 783417 - protein, 265 aa, Homo sapiens; identical to SEQ ID NO: 783414

SEQ ID NO: 783418 - protein, 265 aa, Homo sapiens; identical to SEQ ID NO: 783414

SEQ ID NO: 783419 - protein, 265 aa, Homo sapiens; identical to SEQ ID NO: 783414

SEQ ID NO: 783420 - protein, 128 aa, Homo sapiens
TSSPFSLPGEPSGSNCHYCLHYVFLMFHPRSHPQYICDFLFKTASRFVAQAGEQWCDLGSLQPPPHGFKRFSCLSLPSGCDYRHVPPCPANFCIFSREGVSLCWPGWSETPNLVICPPGPPKVLGLQA

SEQ ID NO: 783421 - protein, 101 aa, Homo sapiens
CCGDSSRIPLSAFGLQLLCRRGGVGGCPPPSCFASGPACCSLWLVNTCLSQKPQLKCQFLWEAFPPRRLRTCPSLPWDSSHSFLVQRQDKLVLPLDYLLLP

SEQ ID NO: 783422 - protein, 106 aa, Homo sapiens
AALKDASAQEGIFNKLAEVFSPPPQTTCGPGYITRGREGGVDGALPVSPPHSPPLAKDTCNFLLQAPAIPYLRAFLATGHERTHNLWELMERCPSFLDLQMGIARL

SEQ ID NO: 783423 - protein, 816 aa, Homo sapiens
FTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRPKSIKEKKKTTSHTRGEIPEESNYVADPGGSLSKTTNIAEETSKIETYIAKPALPGTSTNSNVAPLCQITVKIGNEAIVKRHILGSKLFYKRGRRPKYQMQEEPLPQGNDPEPSGDSPLGLCQSECMEMSEVFDDASDQDSTDKPWRPYYNYKPKKKSRQLKKMRKVNWRKEHGNRSPSHKCKYPAELDCAVGKAPQDKPFEEEETKEMPKLQCELCDGDKAVGAGNQGRPHRHLTSRPYACELCAKQFQSPSTLKMHMRCHTGEKPYQCKTCGRCFSVQGNLQKHERIHLGLKEFVCQYCNKAFTLNETLKIHERIHTGEKRYHCQFCFQRFLYLSTKRNHEQRHIREHNGKGYACFQCPKICKTAAALGMHQKKHLFKSPSQQEKIGDVCHENSNPLENQHFIGSEDNDQKDNIQTGVENVVL

SEQ ID NO: 783424 - protein, 82 aa, Homo sapiens
SCRFSSDSASRSKQHREQGEARERCCHRTFDKLSKCGSGTRGEEGWRALRGREHVRECVCVCGGVCMCECVQECVCGRGVHV

SEQ ID NO: 783425 - protein, 88 aa, Homo sapiens
VLTTPSLSPLRETQVARVSGSESWRHLGGQERKLVRGTLRKGTQPVLPKSGHRCRQLGGSFGWSGVTSLRFTQSTLRGCRDDCLVGLC

SEQ ID NO: 783426 - protein, 285 aa, Homo sapiens
MFVDAAATACLREVVAADPVASAGYLSAQAQMRALLDQLMGTARDGKDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 783427 - protein, 128 aa, Homo sapiens
RPHWKDLAIGDELMENFKPKFVGVKEKMSVKQQAESAEGWGPHSVGTYRVSALEPSDCSGHAPGIGVGGGQDLPPESDGNCPGPGPEIDIGATAAVPGATAGDIVGLPGTEVRNTSNYSDSFGSCNQE

SEQ ID NO: 783428 - protein, 284 aa, Homo sapiens
MFVDAAATACLREVVAADPVASAGYLSAQAQMRALLDQLMGTARDGKDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSQNQEIAGGNHHLWKHPSKPKSTENFSAPRELLPLRNREVYFTIWCCLDPLLSKKKTVGAPGN

SEQ ID NO: 783429 - protein, 101 aa, Homo sapiens
FKQFSCPSFLSSWDYSTASNLRRDSLTGLCKCKVGFCMTLGVGASLNFAPSATPSPVTLLVPTLMGTNAGKAFQMAGTASTKIQRPERPGVFQEQKLGSHD

SEQ ID NO: 783430 - protein, 56 aa, Homo sapiens
MDLPPDTRASSVLSRLTGDHDAYPLPPSAWVTVSPNSALIIPCCPFKITIWYLYKS

SEQ ID NO: 783431 - protein, 116 aa, Homo sapiens
TSYGLLLFPSSSYSPCFCTLKPFSNASQEDLGTFSLGLPRSSSEASLGPGKASELDLGAPGKDGSDGQLISFLSSGFTDVLPLSGKFLGISEFWNENFGDVPRTGKAASSHRHTPQ

SEQ ID NO: 783432 - protein, 106 aa, Homo sapiens [sequence omitted]

SEQ ID NO: 783433 - protein, 256 aa, Homo sapiens
MTSQRSPLAPLLLLSLHGVAASLEVSESPGSIQVARGQTAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDKIPSNYLQQLLRTRSREQSPSGTSVPCLQVCTSAWLLMLLEPAPVFWISRLFHGHSFTGEAKIKRRKKKKFLMK

SEQ ID NO: 783434 - protein, 241 aa, Homo sapiens
MSLVELLLWWNCFSRTGVAASLEVSESPGSIQVARGQTAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDKIPSNYLQQLLRTRSREQSPSGTSVPCLQVCTSAWLLMLLEPAPVFWISRLFHPSPGTLD

SEQ ID NO: 783435 - protein, 242 aa, Homo sapiens
MTSQRSPLAPLLLLSLHGVAASLEVSESPGSIQVARGQTAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDKIPSNYLQQLLRTRSREQSPSGTSVPCLQVCTSAWLLMLLEPAPVFWISRLFHPSPGTLD

SEQ ID NO: 783436 - protein, 241 aa, Homo sapiens; identical to SEQ ID NO: 783434

SEQ ID NO: 783437 - protein, 58 aa, Homo sapiens
DPPPQALLSHRPREVTVSLRATGLILKAIPASDTEVSGSSHCPLPAAPVTDHTCLNAI

SEQ ID NO: 783438 - protein, 149 aa, Homo sapiens
LKPSSCLGLPQCWDHGREPPAQHPLPFIRTSTSRMTLIPSCTDGDSSNSYKHHQTDLQEQRNSQSRFHPRRALKSSRAACYGEGGTLCLALKASASRVQTSSQPGLTIPPPNLCSHWPLFLEHGPHDPRSTCVTTTPPSRPFPVAPPPC

SEQ ID NO: 783439 - protein, 109 aa, Homo sapiens
ASNSFSDIPTARSGARYSSLRPAGLAPGPLPRGAGGHPGTGDFAGLPTLPRLSDFQALGALCELDWLQKSRRPSLYWRAQVAFWTLEMPTLARTPGLCHPDHSGRTEYA

SEQ ID NO: 783440 - protein, 38 aa, Homo sapiens
MSAAKNVSTCVPKSKNPKKSTITRFPSVKTYHREERAK

SEQ ID NO: 783441 - protein, 93 aa, Homo sapiens
WNTKRRREKEGEEIFEVVMDENFPKLIADNKLQIWEAPRTPSRINTRTTPKRIMFKLQKDKEKILKTARENKHFTYIETKVRITFLISNCARE

SEQ ID NO: 783442 - protein, 109 aa, Homo sapiens
AWQSSLSTDHSFLLSSPTLSQPLELKGPQAFSPFSPPTHSSPIPLAPTIPESTRSEQLQGQRLQVSSPTPWELWLQGKGSDIPLSPSATHQMEGIILQRQWEHIPKKPK

SEQ ID NO: 783443 - protein, 87 aa, Homo sapiens
GGRDSGGATRRPALKKQGTHRSPPSLLQLLMIKEGLYISVIGKLVQPGSGWSSVVKARPRALPLSVFLFLLHPRATLQAAPASGTHF

SEQ ID NO: 783444 - protein, 178 aa, Homo sapiens
IKNSTTFTIAAKKKIKYLGIYLTKELNNLYKENYKMLLKEIIDNRNKWKHIPCSWMGRINIVKMTILPKALYKFKELSIKISPSFFTEEKKTILKFIWNQKRAHTVKARLSKKNKSGGITLSDFNLYYKSIVIKTAWYWYKNRHIEQWNRIENTEINPTTYSQLIFNKANKNIKWGKG

SEQ ID NO: 783445 - protein, 103 aa, Homo sapiens
LGTPKGTCLYNNTQYQVCNPGSDQPDVCYDPSEPPMITVFEVRLRTGPFPGDTSKVIARTEERGVPKHVTLKFDACASINSNQQGIGCSSLDWKKKLHSKKKN

SEQ ID NO: 783446 - protein, 32 aa, Homo sapiens
MRFPFVENMGGGGAMQCSCCLGTTPFHPMFSQ

SEQ ID NO: 783447 - protein, 213 aa, Homo sapiens
KKRASFYENIIKAMRPQPEYFAVGYYGQGFPSFLRNKIFIYRGKEYERREDFSLRLLTQFPNAEKMTSTTPPGEDIKSSPKQYMQCFTVKPVMSLPPSYKDKPVPEQILNYYRANEVQQFRYSRPFRKGEKDPDNEFATMWIERTTYTTAYTFPGILKWFEVKQISTEEISPLENAIETMELTNERISNCVQQHAWDRSLSVHPLSMLLSGIV

SEQ ID NO: 783448 - protein, 148 aa, Homo sapiens
KKRASFYENIIKAMRPQPEYFAVGYYGQGFPSFLRNKIFIYRGKEYERREDFSLRLLTQFPNAEKMTSTTPPGEDIKSSPKQYMQCFTVKPVMSLPPSYKDKPVPEQILNYYRANEVQQFRYSRPFRKGEKDPDNEFAVSSPLLSFKR

SEQ ID NO: 783449 - protein, 153 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVLGNVAMLFI

SEQ ID NO: 783450 - protein, 153 aa, Homo sapiens; identical to SEQ ID NO: 783449

SEQ ID NO: 783451 - protein, 143 aa, Homo sapiens
GPFRRCLCVDKGWACPQDPVRGKPNVPPGWQGWGRESVMAAPRKKRGSRGSRTALTWNSCHCLNEGREECTPVTSGGREAQFQGGFPPHFLPCYSDRLQVSLPTLCPGACRKPQLPMVMAPGVGQNTVEGRGFAMLARLVSNS

SEQ ID NO: 783452 - protein, 70 aa, Homo sapiens
RTWRVGKGGWTTGIASGREECQGKSRYRGTGVHPPKTSGAGKGKIRQVGKDKGCNHKESRLDPRELRAKE

SEQ ID NO: 783453 - protein, 114 aa, Homo sapiens
CHAPGHATDSATPQATLLQTPPHQATLPFPATVPVKPTLSAAPTFPSFSCCRKGCRYEDAHLSPVCGTTTQWQGWARSSPTVKSHTEQRPGGKTPKRHRSNNRVSIPAAELACR

SEQ ID NO: 783454 - protein, 148 aa, Homo sapiens
ADCWFLAALGSLTQNPQYRQKILMVQSFSHQYAGIFRFRFWQCGQWVEVVIDDRLPVQGDKCLFVRPRHQNQEFWPCLLEKAYAKTKAAARTSSTAFYPVKGSASACSPGTGTCRSLARSPSNRGSSCSDPIPICTMASSRMPWWTSQ

SEQ ID NO: 783455 - protein, 111 aa, Homo sapiens
MKCSFQKNFAQPTVCNSHTYPGTSESHLQARVAVGSVNPLARIAYPRLIVKWRQPRLLALLETCWLFLTQALTPVPTPPLHSSGPAPNKPTQHSFPRVVCSACVQHLSLNW

SEQ ID NO: 783456 - protein, 156 aa, Homo sapiens
THSQRHAFAEAACAILHSSVFQECHRLVDKEPFYLRCLAAVCGCDPGSDCLCPVLSAYARRCAQEGASPPWRNQTLCPVMCPGGQEYRECAPACGQHCGKPEDCGELGSCVAGCNCPLGLLWDPEGQCVPPSLCPCQLGARRYAPGSATMKECNRW

SEQ ID NO: 783457 - protein, 51 aa, Homo sapiens
RAAAAAAGTANELRARDRGGWTGLELSGGRSYRACKDVGCPGDGPAGAVHR

SEQ ID NO: 783458 - protein, 143 aa, Homo sapiens
EGCGRRSGHGQRAAGPGSRRLDGAGAVGRAEVSSGAGAAGRPEWRKARRFAVPGCRLRPHQKPPDFVWWGQICKPLSAAWLRAREGTWGSDLGLPPGLRGTTSPVPRTAAQRLRLEKLLCLRGWQDWCGLGPAPGSQTEGPGA

SEQ ID NO: 783459 - protein, 110 aa, Homo sapiens
PPPHPPLPRLPSHLWRWQQQCQGGGGFTLHLYQGRTGQPGLYRAGRWDASDWRDRQGATLVLLKPPSLPESSLGRRQALEATDWGLGQSKGRVRGSLARRHPWEPGFPHL

SEQ ID NO: 783460 - protein, 91 aa, Homo sapiens
MYLSSVCVYVCYFVGPFGRVLAIRKEECRACSHSSLCVGSFMSLGSILRVRLPGHNHVVVVSDYKMRPFIFQSGCVPLRLIHDMMGVPALS

SEQ ID NO: 783461 - protein, 72 aa, Homo sapiens
EQMWKASIPIKHLLFRGLCQAKPKFCLQNKGKHSFRLVGISTGSQLMPGGEIGRTAGFLSNLELKEGKPAEQ

SEQ ID NO: 783462 - protein, 114 aa, Homo sapiens
MPIPLPPCPPAGLLSPFRLLEICLQFIFLYFYNSFIEIQVTYCSNNPFKLYNSVVRLNGIHRIVQPPLHQFSNIFISPKENLIPFSHHPQTFHSTVALDLPILSMSYKCSHTIY

SEQ ID NO: 783463 - protein, 58 aa, Homo sapiens
DVLRLCLSLGFPHRGSEPLKEVYLALGRFGEATTLEAPGQNSQAAPRPVSPEGGAGPA

SEQ ID NO: 783464 - protein, 127 aa, Homo sapiens
LRSENCHSRLVRHSMLGSGGGFPGRNVCVEGKFRAKFCWLVVVSAGFRGTTVSPWSPSHLPSPLAGCVVAGMWAGGRASRDILKEDVCLVGWFGEGLIGGMSWASPCRQLELITNSASLICNRETLC

SEQ ID NO: 783465 - protein, 118 aa, Homo sapiens
RYHVDQAEEDGGFPGRNVCVEGKFRAKFCWLVVVSAGFRGTTVSPWSPSHLPSPLAGCVVAGMWAGGRASRDILKEDVCLVGWFGEGLIGGMSWASPCRQLELITNSASLICNRETLC

SEQ ID NO: 783466 - protein, 78 aa, Homo sapiens
PGALNPPGDLPLQEALQAAPAHAEPQLQSSYQLCQEVRTTGLPSLTPRLLYPPAEALSGFALHPSLLSPCSTDSTSCR

SEQ ID NO: 783467 - protein, 56 aa, Homo sapiens
HREGRLQERTEGRLQECTEGRLQECTEGRLQEHREGRLQEHREGRLQKRTEGRLQE

SEQ ID NO: 783468 - protein, 195 aa, Homo sapiens
TISAHCNLCFPGSSDSPASGSRVVGITGKLSGPQARMSQAWVPGLAPTLLFSLLAGPQKIAAKCGLILACPKGFKCCGDSCCQENELFPGPVRIFVIIFLVILSVFCICGLAKCFCRNCREPEPDSPVDCRGPLELPSIIPPERVRVSLSAPPPPYSEVILKPSLGPTPTEPPPPYSFRPEEYTGDQRGIDNPAF

SEQ ID NO: 783469 - protein, 117 aa, Homo sapiens
LHFLLLPNYSTSKTGTGCYSFAPVAVPRTPDTLSLCLPRVCVCTQIHTSCKQLWWKPKTRLAENGIYFAGHSEGLCELESSLSLTFYIEDMKGWSDWFPKVLPTGTACESAGVPTAP

SEQ ID NO: 783470 - protein, 252 aa, Homo sapiens
EAAEGGRVEGPPLRPPATSRRWAGPTLWRMEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELTSELCHRSSGCSTHLQQVLDQREEVRQSKQLLQLYLQALEKEGSSCQSRKSPKLPLVRRWMP

SEQ ID NO: 783471 - protein, 72 aa, Homo sapiens
PDCVEIFRHEDCASASLANLTCDQLADRQSPVIEFWENKVLRLSGGLEVPGALNWEVTLCLLACWVLVYFCV

SEQ ID NO: 783472 - protein, 83 aa, Homo sapiens
LVPPGAQSSSRSVRFRARGLGAGCACCYRAASASGPSSSSLLKHLLSSITEASSPSPVHLFLVEIPAIKRHLGQLPFFCLLPR

SEQ ID NO: 783473 - protein, 118 aa, Homo sapiens
AGAGRPGGLSELEPRAAAAAAARPQGPVRACTQVPWPRAAASCSAVSPARLVRSRRRPRRRKDRTRNSSTAPWPQAAAHITGLLPAESAASGSPLNCTSSCTASRWPRSHARLSAVRP

SEQ ID NO: 783474 - protein, 180 aa, Homo sapiens
GGSKMAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLT

SEQ ID NO: 783475 - protein, 37 aa, Homo sapiens
MQLHWTLVVYLLDFAPQRLRMLIYLAPLDTPTVSSYD

SEQ ID NO: 783476 - protein, 102 aa, Homo sapiens
MGTWGLCSPCTSPGRNCWTSRMRGQRQGQHCPATEDCGPTDDTLSYQLLHLEDDQEEEGRSASVQSDVSRPGALVIPAFGRLRQADHLRSGVRDQPDQRGET

SEQ ID NO: 783477 - protein, 110 aa, Homo sapiens
CSRGYPPVRCATDSIDTSQRFQSKFEVGSPKLSSAEPFLQAPSCWQAPSTLPGPCNPFSCPPLLQEGEEERRVEKALTLWPRAWNSTSLRPPHKAPMAFWRRGQPPCQKK

SEQ ID NO: 783478 - protein, 141 aa, Homo sapiens
VCSQRGRRETRRVGDLEVRGEERFSRPQWLSVPSAAEKPARKTEKCPVDLLPGKPWVTLARAIVESSGSEPEAILQPSLLSPDIGQCLETFWLSQLSIGVSCWHLAVGDQDYCKHFTMDRIVPHNKELSAETLLESDGGGT

SEQ ID NO: 783479 - protein, 133 aa, Homo sapiens
ICFVGQAPQVGKGLSGSCPPPVPFSKSWNSGTGRMLPAAEGGEQMFECPLSEAHQLSNWGPPLALISNSLARVRGQEVSHSSCWGRRRRPRGQQLCPTFLPKLGLAIFWWIKEGSQLAGQSWAGPCASLGLIR

SEQ ID NO: 783480 - protein, 85 aa, Homo sapiens
DDKEEKNPGAVTARRPQHPRTSARYEHAPTGMSKYSMKCNNAYFYEIYEILAERQRRLDRGDEMKGLSGGKDSLACSFPLSHKMQ

SEQ ID NO: 783481 - protein, 126 aa, Homo sapiens
PGYLGRNTGNRILNHTVISCWRAPGICGPQVLIVECIFVLSLTCRVTSLPLFLCAGFDISQMATVVGRRPGCLVQELMKQNRKTFYGQLWKHSETAALLSNYIYCVCFIPHREGSQGKNTFLFIVL

SEQ ID NO: 783482 - protein, 64 aa, Homo sapiens
MKIKPPACSVQSSFTLSLHSVSWTHHAPSASDLSCVFAQAICSAENTVFPQPSIPLTSGQIRGL

SEQ ID NO: 783483 - protein, 73 aa, Homo sapiens
RRMSPKTYRAIERRKHHIFGVFQLSEACGPQEALQVWEQLKVTVLVFWVAGPLWQVCGHSGVSAPSRHHEIVT

SEQ ID NO: 783484 - protein, 75 aa, Homo sapiens
KTLTLFLAPTLSCFLVLGEASCHSVSCPGDGPCGRDQWWLSAISQHQTEALSPRNHEDLSPAKSHVLLGLEVTTP

SEQ ID NO: 783485 - protein, 75 aa, Homo sapiens; identical to SEQ ID NO: 783484

SEQ ID NO: 783486 - protein, 71 aa, Homo sapiens
CETRAWLRCPELSCRGVAVDSRYQLILVLWHHSDCVLVYLTVPWSLRAFLVPSSCSWLTQTDCCWILLTNL

SEQ ID NO: 783487 - protein, 648 aa, Homo sapiens
SLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 783488 - protein, 464 aa, Homo sapiens
RLRGAGVNRTRHLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 783489 - protein, 648 aa, Homo sapiens; identical to SEQ ID NO: 783487

SEQ ID NO: 783490 - protein, 411 aa, Homo sapiens
VFQRIPGFLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 783491 - protein, 109 aa, Homo sapiens
LNKAPPSLRLFSKCRQGTVPRPLEATPNLPCDLDPPRLRGISRWQPLQPLPRRLHLRTGGSNTEKRARAPQPLLGALCVLNKHKRLNYQPLRHSEPQAQNSLLFWPHIK

SEQ ID NO: 783492 - protein, 76 aa, Homo sapiens
HEATEDTGYLVGLGRLDFRHRVSCLAEVQVPCKYRYADFYRPVGDHEDFGSKHNRLEALCFCDIRGIALRDQFLPQ

SEQ ID NO: 783493 - protein, 111 aa, Homo sapiens
MLYPLPQCLSSRHSQSRFLHAMQISAKTHLLKKPSLTTQSHLPPLPLQSLPHHLALFSVHLFLVSCVSPASFTRVKFHGGRDGVGVAHRGICRTPNSAGHTEGAGRRKRPL

SEQ ID NO: 783494 - protein, 86 aa, Homo sapiens
SEWRAQVWWLERLWCDALPYFDQGYEASGVQEAAAVLVEKETRRYQPTMNYLRYLTVLDYSCRNGTLGHYMTTTAILTQNLVSWAI

SEQ ID NO: 783495 - protein, 72 aa, Homo sapiens
GEGILVEKGGRKGCGEPCGGGRRRAENPEEGGGQSRSRCEQRKKKRGQERTKEKLETEVFLEQGLGQAAQVG

SEQ ID NO: 783496 - protein, 79 aa, Homo sapiens
QGPRTWLVPIFRGIHGTGWRRRVLRDTGLTVKEAGTRPPGSSQDTLHGRARLSPGTPCSGLQSNAHPGLSPSPSLWPPP

SEQ ID NO: 783497 - protein, 102 aa, Homo sapiens
WCVGRSSTPVSLPVSGAALFSCAQEERPGAGWGCCRCRSQPRTGLSAHRHQGPGVPGVCPTCTDVTAHVGLTQAHTDNVHGCHSTHSLTQTSQHVGLMGTCR

SEQ ID NO: 783498 - protein, 102 aa, Homo sapiens; identical to SEQ ID NO: 783497

SEQ ID NO: 783499 - protein, 109 aa, Homo sapiens
LSAGRPSDSQHGGQETLCKQNCHNHSAFNSYHPDKSAASIVEAGPSTSKKIMTHCRLGGLLLSFFFFFLAMKKPLMSRNTPMGPLSARWNLLKMHHMEQKSAVLKQRFM

SEQ ID NO: 783500 - protein, 114 aa, Homo sapiens
GAAPDRLSWVGTLRDVPSDTQTQEAAVSGGAGEAGTRGPQQSCPPGMPWQSAASTMESILGQAEGWKYGQREEFLALKGLLAGYGDETGTHVHRSPGPGHHAQGTAGIVLAPRA

SEQ ID NO: 783501 - protein, 53 aa, Homo sapiens
VRGDSRGSAGGPEWLGLQDSSEIHFKVKMTTHLKKLKESYCQRQGVPMNSLRS

SEQ ID NO: 783502 - protein, 67 aa, Homo sapiens
HAGESFKVDADIYGKPIPTIQWIKGDQELSNTARLEIKSTDFATSLSVKDAVRVDSGNYILKWGFPS

SEQ ID NO: 783503 - protein, 109 aa, Homo sapiens
HAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQD

SEQ ID NO: 783504 - protein, 155 aa, Homo sapiens [sequence omitted]

SEQ ID NO: 783505 - protein, 155 aa, Homo sapiens [sequence omitted]

SEQ ID NO: 783506 - protein, 78 aa, Homo sapiens
RKWNFLSRKNAHEPKKEKKNSEGSSFLVHTINGQIAEKIALERTGFSRKRDDGERGHKCQHQKGESLGHIPLAGEVCP

SEQ ID NO: 783507 - protein, 89 aa, Homo sapiens
MLESKSRQVSCWFPDLSLIVAPQSETEKPKSLEGIQTSEGIQCWWRPIKSNLYNIPNHVSRGAKRTCPSRKHQETFRKENTNSLEYCHR

SEQ ID NO: 783508 - protein, 46 aa, Homo sapiens
TPPNSRISLTYSPVSLMFSPPALRYSSVSLSYSPTISRFHLESASR

SEQ ID NO: 783509 - protein, 255 aa, Homo sapiens
MWEWKICNSHGARPFAEPAGWEFVNLLRHHKSFLIAPLCLSVPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 783510 - protein, 341 aa, Homo sapiens
MWEWKICNSHGARPFAEPAGWEFVNLLRHHKSFLIAPLCLSVPVSRPVLTLRSPGAQAAVGDLLELHCEALRGSPPILYQFYHEDVTLGNSSAPSGGGASFNLSLTAEHSGNYSCEANNGLGAQCSEAVPVSISGGWVFLDTEFDVNGCVSPAWRCLLCVKRGKVISVSSGFSSPHTNLKSTDYTSMISYLNLYLTSLYSIYKKGPSLKPLGLKHCFLSSGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 783511 - protein, 508 aa, Homo sapiens
MLLWSLLVIFGEFNNLTDSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 783512 - protein, 192 aa, Homo sapiens
MWEWKICNSHGARPFAEPAGWEFVNLLRHHKSFLIAPLCLSVPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGCIYHLDSPYFAMTFPLLI

SEQ ID NO: 783513 - protein, 101 aa, Homo sapiens
VHVLEKVEVPLKGSSPRKLPILLPSPGVRVSVLICCFHVLVNLYFVSSCRYYCWALGKREINEDSCFLSILFKEYTILYLASSIRAELPRKLPLSILAFFP

SEQ ID NO: 783514 - protein, 81 aa, Homo sapiens
AHTRHTRTDAHTRHTRTHTHARTRTRTHTHTHTQTHTHTHTRAHTHAHTHTHAEGEPREGIQNRILKKRKNRRFTTRRSES

SEQ ID NO: 783515 - protein, 91 aa, Homo sapiens
MLFTGIPVCVYDVPPSKTNNNTVNVGPGFTKQRPRVIGSTAMCVSVSLHFINFVHCGCTPQNETSLYACNIPCLLQLTIYCLSCYHILAGS

SEQ ID NO: 783516 - protein, 41 aa, Homo sapiens
IAQVQAFIGSHLDYHQTIRSLLIPSSTLRPDSSPPSTHMSY

SEQ ID NO: 783517 - protein, 71 aa, Homo sapiens
LAAEREFRDSSTRGARIQSVTPGGVLGRYWEALTDSGVDGNEALNCERIVGEKEEQGIFIKGIDRDEVSGG

SEQ ID NO: 783518 - protein, 56 aa, Homo sapiens
EKHSPLGAAWEVADFQPEQVETQPRAVSREEPGSLHSGHQEQLNRKRERRPLPKNG

SEQ ID NO: 783519 - protein, 119 aa, Homo sapiens
KLGTGDTYGGSMNQMKYITEEVCFFLLYFPLPPLITLFFFNNRSGLALPRLAQTTSLVLNSTPWTSHKASWSFVLFSHFPLPPEFSHSVFPNYRLCQGAPVLKTVHQVETSVVSVSVFF

SEQ ID NO: 783520 - protein, 119 aa, Homo sapiens
KKQGRWRVCERGSEKGLSHLSGQVCGTQIRLICISSNKLLGSECLKQAECREVSKYVRSEFQAFCSQLLGGAAVPWGVLPCLHRVPCLAALTLRNGLHCGPVETGRRISYPAGLRATGT

SEQ ID NO: 783521 - protein, 54 aa, Homo sapiens
EPTDPWEWGVGRGGVASHCDQGLPGGSGAPSPPPHSPVSPPSQLPGPLMYQSCL

SEQ ID NO: 783522 - protein, 69 aa, Homo sapiens
VQPSVCGQKPESPWQTTDIESSVQKLKNLESDVQGQEASSTGERRRPEDSASLILPTSACFILAVLAAD

SEQ ID NO: 783523 - protein, 108 aa, Homo sapiens
GLFFLQFLPGLVFDCLLWSVSSAFLIGGFPRMSGDAICLCVMGVSTSRPQRLGVCTQGGARGASEQVSVGSSPLPVDSVERVGQSVSSGWSVSQPSLLPRSVPWGSGR

SEQ ID NO: 783524 - protein, 154 aa, Homo sapiens [sequence omitted]

SEQ ID NO: 783525 - protein, 70 aa, Homo sapiens
GDYILLVVQAKDLAVLLEACVSPNPTSNQAAHPAALTFKTSRIQSLLATSTAPHWSEPMSPVTYMMTSAP

SEQ ID NO: 783526 - protein, 101 aa, Homo sapiens
DRQCPIPKVQAGTHGKGILLPSLPLPAPPLRQSLFLVPNPPQRESTRGMYFSFFSGFLFTSLGSAGVCTHLRSCTQPLSKLHIHEWSWDHSLPSPAKQTQP

SEQ ID NO: 783527 - protein, 103 aa, Homo sapiens
SEFFISVIALFSSKLFIWSLCKISTFLLMFSIWGNLQPPSSEALPMSRGLCIPLSSIPQFSNFILLKFLTDQATHEPLPMTHSFMHYWGIISHPPPCMGLFGF

SEQ ID NO: 783528 - protein, 123 aa, Homo sapiens
LPFLKCLGWRVRVKFLTLACYAEQECNERVSSGTEVCRLCSVKSLAQLSSLTFQNFSSCGLHGCVHLSILYPPLSLSFNPEATVPLDKYYYLRLHGCFLKVLSQSLQILSDHLLTHSGVAYGV

SEQ ID NO: 783529 - protein, 68 aa, Homo sapiens
ASEVTGQGPVFSRLAEKESVKDLGPEFQGLWECLPDSSEVPAGPPTAPVLLMKLDYSLQQFLFPCFGL

SEQ ID NO: 783530 - protein, 152 aa, Homo sapiens
PSWGSHTCRGTHQRVLSLKLHLQGVHRAAQLQDLQMTALQLLEQDMACRLMPSDWSTERHNYLPAQVDAESSLLCSLPSSGLGTTAPHPGSWSPPRPHTGPISPLTAQVRSGLSPQLNPELVLCTPQSAGFLCTQKEQTLHSFSPPPNVLPT

SEQ ID NO: 783531 - protein, 101 aa, Homo sapiens
PACLLGHRCPLHQRVVSPTSAFPVVSLSPGLYLGCVARWQTFSRRFQFGFVKAWATWAPASDPQGFSSPPYPEQPLCWDQDDHTPAKDKVLRGAHCPPAGG

SEQ ID NO: 783532 - protein, 79 aa, Homo sapiens
FCYARPQFPHWDHGALSGEGADQERLRGESGDSQNRGGGLQPAGHSSTWSSGSPSEHVTGILGLRAPQSNGVPPPPPTS

SEQ ID NO: 783533 - protein, 104 aa, Homo sapiens
RDKIRIEPDPREGGARASHYAHYVGKRVNRSSNHSITQYTFVTNLCLLHRGYVCIPESKIKIEKEKIIKKIKGMRQMLTVVISRKWKYELFLYSVLLLYALLFL

SEQ ID NO: 783534 - protein, 142 aa, Homo sapiens
MTPSARMSQPEAEEAAWLQVLSAMIVYALMVVSYFLVTGGIIYDVIVEPPSIGSMTDEHGHQRPVAFLAYRVNEQCIMEGLASSFLFTIGGLGFIFLDRWNAPNIPKLNRFLLLFIGFVCVLLSFFMARVFMRMKLPGYLMG

SEQ ID NO: 783535 - protein, 104 aa, Homo sapiens
TQRHTTQTQTHTHTLLSCLTSSVSPAAMEGGFWCLYHALYLFLWESSGQGRALRCYRRAQKWYRSFPVPQVVYFGTFPVIDLGPELRVPGIEGRPHPCPRCHSP

SEQ ID NO: 783536 - protein, 173 aa, Homo sapiens
VDEAANTLMTRLGFLLGEKVTEVQPGDQYSMEVQDENQTSAITQRISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSV

SEQ ID NO: 783537 - protein, 109 aa, Homo sapiens
HLKGSIQLFEAKLDKGARMLWELAIDFSPRCSENPEKIIATEQNTCAMEKSGRIYTEIIRIWDIVLDHCKLADSIKAICNAYNRGLSCVLRKKLKGINKGQVSANMKIQ

SEQ ID NO: 783538 - protein, 368 aa, Homo sapiens
IATGPLRSRDSLYRIRPSKPVCIHKNSCLKEQQKRYFSVFSDRVVYTPESLYKELFSQHKGLRDLINTEMRPFSQGILIFSQSWAVDLGLQEKQGVICDALLISQNNTPILYTIFSKWDAGCKGYSMIVAYSLKQKLVNKGGYTGRLCITPLVCVPESLEKAQSVYSSYLQIYPESYNFMTPQHMEALLQSLVIVLLGFKSFLSEELGSEVLNLLTNKQYELLSKNLRKTRELFVHGLPGSGKTILALRIMEKIRNVFHCEPANILYICENQPLKKLVSFSKKNICQPVTRKTFMKNNFEHIQHIIIDDAQNFRTEDGDWYGKAKFHHSDSKGWPRSSLDLSGLLSDLSLELQWPPPSLRPVSKRRDQ

SEQ ID NO: 783539 - protein, 120 aa, Homo sapiens
LLSLGGNTGPAPHAVAPPSLPLQGAEDKRCPCPGQANRPSLVMGWGGEKCVLLMAGEEEGLDISSQGHARRLVTLQGDAEESGAHSLQLFSPQGRILTPPAQVPPIGLSLAQERKVLWSE

SEQ ID NO: 783540 - protein, 121 aa, Homo sapiens
EQGTPTSLARTGGASAGTCPKGAPSPVILRVRQACQPVLSSLSCSQATRKPLGAQRPRLTRQLGRAGHRGRSDLPRSCSDMEPELKDHHSLQATSLLCCWLSLKTSVFQLTKAVHGNVIGE

SEQ ID NO: 783541 - protein, 78 aa, Homo sapiens
GSVQRIPSDAKWWWGDGGRERRRGENSGTQQESTFKSSSENRSAYMCEKTTDTKKNCWKDRRINLQSTHGSRNSLYAH

SEQ ID NO: 783542 - protein, 87 aa, Homo sapiens
SPNALCSCGKSCYRGIPVLIADTSLERCNLLRVKSPTQHKLCLSTFLTQCPIQHGFYGGVFIWAIVSSFLHVWNFPYIRKPFPIVIK

SEQ ID NO: 783543 - protein, 107 aa, Homo sapiens
AFGTPPFSLSIPSHNDLWPNYNSVPSTFHASALWPIIHAVPYSLNLHVKFFMILPHAPPLLAPRSPPYSPFSLSIPSHNDLWPNYNSVPSTFHASALWPIIHAVPPR

SEQ ID NO: 783544 - protein, 90 aa, Homo sapiens
ASPRGVQQAGIHCSLALVPFAGACVWAAGPITRRQPSGYGAGLLQGWIWAVESGWHPGGCVGPAVALLGLTSGWRSEGGGYTEICLYAHI

SEQ ID NO: 783545 - protein, 126 aa, Homo sapiens
FPTHEEEGTRTAWSEDQTGPWGQGGRGRPAKQDLGHRGRKPALPHVETSQREHRQGLTRHSTGPALQSSQRSPELQVAMVPISQAPSGARLASVHTPLTPSPMPSWPLSWRAFPHGTHWMSEGTYL

SEQ ID NO: 783546 - protein, 151 aa, Homo sapiens
TQAQKTRHYSAVKKKLAEAGRQASGLEIAWGCVLALHLVRASWASATSLRCNLDKRGTRQSQDQLDGETWHPADCEVPDAFSGLWGGADYSPSHGHSRLLPVPALSRRAPCVRRSRGAGTPARQGESRCRRLRYTNSASHHARCHAGHSVP

SEQ ID NO: 783547 - protein, 108 aa, Homo sapiens
LHSRLGRQSKTPSQKNKKRKKKKCFLLMEAKELMPLLASPVKAASSFFLWLLSIWLRLAAGIKPGLSLVPNLELLHISHLPQGLFLLCKSTHKNIYPRAACGCQFVYT

SEQ ID NO: 783548 - protein, 39 aa, Homo sapiens
MVKAELTTGGVLQRGGLQRSWQAPIFMDVGEWEQRNWRL

SEQ ID NO: 783549 - protein, 43 aa, Homo sapiens
VIRAEAPLKITQERAPQTHNPNLQAPACKSERYTKSNFLFYSF

SEQ ID NO: 783550 - protein, 84 aa, Homo sapiens
QALGWGVCESATALPTSPHEASSHAEQHVLQYAIFSKSHHLSAASLTQGRLWPQKPRLSSTWNWTQLSLLSFSSQGATSGEAPA

SEQ ID NO: 783551 - protein, 77 aa, Homo sapiens
HQASPSPTNNQQVGTSARDPSAQKHSPSPSGGPETPLPQTRHTLHQGNPASGTTITSTWPRRHSPSPLVTGLLSPLR

SEQ ID NO: 783552 - protein, 110 aa, Homo sapiens
TRGSSIHYLGLLHHPSPGAPPSSLTRGSSIPHPGILRHPSPGISPSLTWGSSVPHLRLLRPSPRALPSSLTQGSSIIPQPGLLCHPSPRAPPSSLTQGSSIIPHPGLPEG

SEQ ID NO: 783553 - protein, 77 aa, Homo sapiens
RYDQEDELVPVGVCHIDPVSLFLYNPCAFLFYSFSARLLWASGPLPWQILSHAPVVCLWTSFLLFLVSLKHPPSLTY

SEQ ID NO: 783554 - protein, 143 aa, Homo sapiens
HPPSTMAVQASPAQSRRAAHSAASETPLGAPAFFFPLIHDFIFFFGFTWRLAGLGSPGSAPLHIVAVAWDPSGARAPAARGVRAPAGLPGGRREDTHCGSRSPSSRSRAPPAGDVIPSASAAAAAAGSGAGPARARHCAAARP

SEQ ID NO: 783555 - protein, 73 aa, Homo sapiens
RRLLLLNSRPRRPPAQKAPALTAFQGAPGPLGKIYTKGHSLGSGPANPSSFIFSTPPTHHADFQPCLNAGSHL

SEQ ID NO: 783556 - protein, 74 aa, Homo sapiens
NSEFSPVKILIVLERNQDKLVFQGATREFGALTVAQNQSLRERGPARFLLKGGGAPDSQGLGPGAGPAAEAPLP

SEQ ID NO: 783557 - protein, 56 aa, Homo sapiens
PQNQHFQTNSQHSKRRQLGGLVPPLDETIPGEHVPLSSKINKSSASKGNHGGHPIP

SEQ ID NO: 783558 - protein, 141 aa, Homo sapiens
GSLTILLPTVCSRISSGVTLDHAVPWNLASPASPSLTPCWAHLVLFPASVLYPCLWRHSSCSQGPSTALSCVSASLLWTHLGSNPGLRPSFIAFSFPKELTHLQGFHSNGFFNSGIFHFQSPQTSLWNSDPGLLTYKQIQA

SEQ ID NO: 783559 - protein, 139 aa, Homo sapiens
ARPERGPRQDRSPQARAPMNLAGAAFTNARAPGRTLFWHSISERPTRPAPPRTKLAAAPARGLPARGQVSGGRGAAVPTPPIARPRPARASPLALPLAAPAPGLGGLSPLQSPTLPAPPLRKGETQRCRRGLPAPLPSP

SEQ ID NO: 783560 - protein, 62 aa, Homo sapiens
MTPRYNVLIKTMPESSGTRIIIPNAFDLLVTVAPTTSCVFPPLWPCPGYVSPLCFHQEKLDQ

SEQ ID NO: 783561 - protein, 113 aa, Homo sapiens
VLLDSSRMPSHLILNLERKRRPKVVFVSLFMCLFLFTSVSVCVDKFFLFSCQSAFCQLIFSKTLEGGGEATFVPISNICAQMKAHHPEFLYFFQPPKYNHLPFPAQDLVPSSS

SEQ ID NO: 783562 - protein, 105 aa, Homo sapiens
MCMCVRERLYGGWECVCAMFRSGAGGVAGGTETLTPFLWGARMKAGSVPREPWCRSPYSGRREPKESWVNPGPAFVSVKCTLYECKLQHGPWQARVVGSGVLKAI

SEQ ID NO: 783563 - protein, 110 aa, Homo sapiens
QQRGGPERAISGFLFLKPGSGCPAHHQHFQYWKLQKLQLPPAQHQRQALCTGLCSDHGQPGERPPAWVEEVLECRGARKAREVDHHGWDRALGSNPAFSFSTSMALSKSS

SEQ ID NO: 783564 - protein, 69 aa, Homo sapiens
QVIRLPLSPRPQRFIRVAVCVCVMGGGVFKVLLASLNQLCPLAVTFQALPGSNSFSGSPSIDQQTHCDT

SEQ ID NO: 783565 - protein, 143 aa, Homo sapiens
QSHRRLSSLNEQFPNPTVIFSSSTNEIVKKPRIFIKLKIKPKHSNLFSKSLLTEKHRKFLILKLPSLLGSLSEIPKCAPNWAFFLSLGRAWGGCGGDELERSSQAGETLQQLGNHLPVVIYSVPLKISMRSQYIKCMTPNICN

SEQ ID NO: 783566 - protein, 38 aa, Homo sapiens
EGSRARMREDYDSVEQDGDEPGPQRSVEGWILFVAGVH

SEQ ID NO: 783567 - protein, 723 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLDAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 783568 - protein, 723 aa, Homo sapiens; identical to SEQ ID NO: 783567

SEQ ID NO: 783569 - protein, 615 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLDAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHPPEPGSQRPSLITDLLPPSCLD

SEQ ID NO: 783570 - protein, 674 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLDAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPFPTAQEPPS

SEQ ID NO: 783571 - protein, 723 aa, Homo sapiens; identical to SEQ ID NO: 783567

SEQ ID NO: 783572 - protein, 690 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLDAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 783573 - protein, 154 aa, Homo sapiens [sequence omitted]

SEQ ID NO: 783574 - protein, 667 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLDAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPGTSTAPASSRQGSSRMCGLWWGQSFAYISG

SEQ ID NO: 783575 - protein, 92 aa, Homo sapiens
GDTLGACPHPRTFYRNSRAESMWNSCCDSPGAPRLLERLLCSRGVCESPTLSDPTFHPGPETLAAATLLPAYHGTQLLRREGLEASSPQGLQ

SEQ ID NO: 783576 - protein, 360 aa, Homo sapiens
MALDVKSRAKRYEKLDFLGEGQFATVYKARDKNTNQIVAIKKVPLCRTGWSAVASSRLTATSTSPRLKQFSCRSSQLLTSTDLPTIGLPKCWDYRLRATTPSLQLVILSQHYFRILYIRQGFTLIVQSGVELLALSNPPASASQGAGITGVSAGSHYSCECAVSYLKPICLGVHLRPMIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPKQLVAQIENGVLKLGRFVGLAKSFGEPKLELIHIQVVTQVGIGAPELTYCGRLRLYWGRCWACWAGADISEGTPRVLLRGIQGE

SEQ ID NO: 783577 - protein, 206 aa, Homo sapiens
MALDVKSRAKRYEKLDFLGEGQFATVYKARDKNTNQIVAIKKIKLGHRSEAKDGINRTALREIGHKSNISLVFDFMETDLEVIIKDNSLVLTPSHIKAYMLMTLQGLEYLHQHWILHRDLKPKQLVAQIENGVLKLGRFVGLAKSFGEPKLELIHIQVVTQVGIGAPELTYCGRLRLYWGRCWACWAGADISEGTPRVLLRGIQGE

SEQ ID NO: 783578 - protein, 224 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPKQLVAQIENGVLKLGRFVGLAKSFGEPKLELIHIQVVTQVGIGAPELTYCGRLRLYWGRCWACWAGADISEGTPRVLLRGIQGE

SEQ ID NO: 783579 - protein, 77 aa, Homo sapiens
DSTGVILSQSYPGSYPQFQTCSWLVRVEPDYNISLTVEYFLSEKQYDEFEIFDGPSGQSPLLKALSGNYSAPLIVTS

SEQ ID NO: 783580 - protein, 76 aa, Homo sapiens
KKKKIPWVKEKESESFLCAFDPSTEEMLNSRNSNPTTEGFEYILQNSKGKTFMLIVEFIRVSDVEKSVGKQRLFVF

SEQ ID NO: 783581 - protein, 126 aa, Homo sapiens
ASRVARTTGTCHYTPLIFVFLVETGFHHVDQAGFQLLTSGDLPASASQSDGITGMSHHTPPNSAHNAMFHLGNALPLSESHFSHLKEEVTVDDSEHLGCAEFYTKHTVSNSPNTPTRQVLLSPFYF

SEQ ID NO: 783582 - protein, 81 aa, Homo sapiens
PSLVGSSCPMQQGKGPTELITYRCPRTTEVSIVTHSLGLQGSQAPLPGLAEGTPQSLLLPAPKAASWVLHSLSHELHPTTG

SEQ ID NO: 783583 - protein, 69 aa, Homo sapiens
LIAAAEATQETVESLMQKFKESFRANTPIEIGQLQPPLRSTSAGKRKRRSKSRGRPSWHIWPGSQKVVL

SEQ ID NO: 783584 - protein, 37 aa, Homo sapiens
PIEETTLAEKLGMSEVSRVGRGIMTRGTSIPAWHSVN

SEQ ID NO: 783585 - protein, 117 aa, Homo sapiens
GCVHTCRGVGVALCVHTWTHVSALVWLHVSAGVCVRGCVGACVCGYMHVWVHVSGYMHVWVHVSGYMHVWVHVSAGVCMCRCVCRCMCLCIWVCACVQGCTDACVHVCGASCGCICV

SEQ ID NO: 783586 - protein, 46 aa, Homo sapiens
GGHQQLSGTADGLRLQTLACSEWGGAPGALSKKKAPGRLGRRRPAP

SEQ ID NO: 783587 - protein, 74 aa, Homo sapiens
TPLPYAQMSDPRSLRARHVSQDLLFHSPTHTDHKSGPPVTLLTDWLQVGVPTSPSLGLYLHGVPHRTLTFTGLL

SEQ ID NO: 783588 - protein, 115 aa, Homo sapiens
EAEWGREEELSCEAGPTATPQGPGVVSWNGLPESRGWDFVPRIPSVTEHECPQEDIACREAGPAALSAPPLQRGPVPQGCRAEDEVCCQDVHKACGSSKDGGSLGDGVQWGHLEE

SEQ ID NO: 783589 - protein, 131 aa, Homo sapiens
AYRGSRLCSQNHVAGTLYPASHQSLSMSVPRRTLPAGKQVLQLCLHRPCSEAPSLRVVVQRTKCAVRMCTRLVGAQRMGAAWGMECSGDILRRQRLSQAFEVELDGQREQNLGVPRGTFGAVSGSDVEGGR

SEQ ID NO: 783590 - protein, 102 aa, Homo sapiens
MLPCTSRPGFSNFLPPASPSLLTHASLSAHAHPPPEPLSIVCSQCALSGCFLSGTDHYTLGMPAMVFDVSEPLLGFPLVLLSCRQRLCMSSGFSKLHEDRET

SEQ ID NO: 783591 - protein, 129 aa, Homo sapiens
DLEYPQAVKTDSTVASRSTILSFTGSSENYNICHTPAPLSFTPYSTTNPFTGTLLLTQMGRGEANRELTMGEYLEKGILSFTPYSTTNPFTGTLLLTQMGRGEANRELTMGEYLEKGYSRQRKQPMQRT

SEQ ID NO: 783592 - protein, 109 aa, Homo sapiens
LTVGLRPVDSVPPIPYPSPEVPFLGQVPPPAGGTEEVATIRVSGVGNNISFEEKKKVLIQRQGNGTFVQTDKPLYTPGQQGKSHIFGVRLKPGETAVHRGKEGICGLTV

SEQ ID NO: 783593 - protein, 39 aa, Homo sapiens
EEARDRMKRRCGLVTGGQQGLDAQSIRFKGTGMYLQSNW

SEQ ID NO: 783594 - protein, 122 aa, Homo sapiens
LVLFPDLSQSSSHAHCFSNSSYHALACGGPATSQASTLDRNSPTKLSNKSLDRDTAGWTPYSYVNVLDSHFQISALEARYPPEDFYIELRHLSRPAEPHSPDKPWIQERTDRTRAERCLWNG

SEQ ID NO: 783595 - protein, 123 aa, Homo sapiens
MEELNPYTKISPALGAERHSVGAVTGIMLLLFLIVVLLGLFAWHRRRQKEKGRDLAPRVSYTPAMRMTSTDYSLSASTTPWWPVMEHLARPFSQRPRTQLSNKSLDRDTAGWTPYSYVNVLGQ

SEQ ID NO: 783596 - protein, 79 aa, Homo sapiens
LNNMPALNSKTCYPGIESNSSCQAWGPCEVTHGQLLVRGQEAGMWGPDPLDPHHEAVVMLWRAQAWHPGTSHRSPGRKL

SEQ ID NO: 783597 - protein, 116 aa, Homo sapiens
KQWMPMAEFSRCFWMEKLLVITISMSIFRVVVLLPRSQADVLWVECGDDQQEGPGLPVEGRDGEVRRLVPRWELDVFRVMVGAQIQNGVDQLGPPHLQHLHIIRLHGSQPHHPLNG

SEQ ID NO: 783598 - protein, 120 aa, Homo sapiens
TQKGVTSPTFHKSSEHCRVTVGTPEIKHGGEAGQGSQEAQHPDSTEPGWAPRPFCHPQTRGFCTSDDSIQISSLSCGPIHAEADSAGTRTIFHTPMIAPHPISSTHSLVPSSLQIILEKP

SEQ ID NO: 783599 - protein, 102 aa, Homo sapiens
AIPLEKGRGGARRIRKPPHLGNWLPHLFSVMPETAARAMSSPLGRPCPYTHLQQRHHLWTCGETPWEVKPHYTERRVGSRAGTNRAVGTEPSSTLVSLQLWP

SEQ ID NO: 783600 - protein, 61 aa, Homo sapiens
MSSLKIEDKATTFHKMRPDHLPPSSPCGLETESTFLSVLDLNVPPCKGNKEWTFRLMASFK

SEQ ID NO: 783601 - protein, 54 aa, Homo sapiens
RGAREMRYGGKADAGEMTQQNSAKTGLRVQESERGLRQGAIAHAHNPNTLKTEV

SEQ ID NO: 783602 - protein, 112 aa, Homo sapiens
GFLRWNPVLRFLFSLGLCNKRPRGSLSILQIFTSSLLSACCRGESEPLLVRTPGNLQAITGNRQDSKWSIKTELVRTPAGGILMDWRPRLSVMMNKHWRRALKGQGVLCCSA

SEQ ID NO: 783603 - protein, 124 aa, Homo sapiens
PPEGDFHGALAICQPRQQVLHLSSLLSPRINCLVPSLSPSLPTQGSSPTWKKGTQSPRPHPAPILGSLGKYLESLHFLFSTLEPTPASVPPLPLHRHCSFHCHLGPTVKHSPDHVSPGCFLLLH

SEQ ID NO: 783604 - protein, 97 aa, Homo sapiens
LHTTLSQYNQSMGYPPDLHTTLSRYNQSMGYPPHLHTTLSRYNQNMGYPPHLHTTPSWYNQNMGYPPHLHTTPSWFNQSMGYPPHLHTTLSQYNQSM

SEQ ID NO: 783605 - protein, 106 aa, Homo sapiens
SSGLARALPSSGILFPQVYTVSVSYLLQVSLSLSLSFFGEGGRALGPSRAGTPMLAGAWGRPTSLNTDGHEHSSPQGSEHLTDGGLCHPSSPCPLGGWGTLSSVGR

SEQ ID NO: 783606 - protein, 39 aa, Homo sapiens
GDEEKHRDHARLIGCVEELEFYSNCSGPQPEGLGYWQED

SEQ ID NO: 783607 - protein, 101 aa, Homo sapiens
LGLQCRSGPKSPGEHRPGHGNRRPGPGQLGMLTLHQAPHWASHGASSLVPPSSELLVPLSVFGRGRKLEALRGRAGIGVHSQLPGLQPAQYPPLPHPLFFY

SEQ ID NO: 783608 - protein, 113 aa, Homo sapiens
ILIPSRGLVGILFHPASFLQRLVTSAKPGPSGWTHTHDSRNELCGNWIAGWPGHPHSPLPPIATTPLVYPIKLAFSLQLLSRTARAWKIIVSCRTSCSYSLSLPSSNMKQESL

SEQ ID NO: 783609 - protein, 48 aa, Homo sapiens
MLPGCAYGSRAHSTDKRWAASQTLPGPRGAPRLGVEWRLASFDSPSHP

SEQ ID NO: 783610 - protein, 51 aa, Homo sapiens
IKTGNADEAVTIHPVTGSISVLNPAFLGLSRKLTIRASDGLYQDTALAYST

SEQ ID NO: 783611 - protein, 140 aa, Homo sapiens
LALSADPSPGSQGTRGGERQRGRCVGPTGPWPRLAHRPSWKTVRMEKPHCGSMKGHIPARHNWSGSHIKSPSVGRHPTANLRVFWGNPSSASVSPSGKQGRTSRGGSLRRFPPTLRSESPPLSQLRGWQQSRTRDGQGPE

SEQ ID NO: 783612 - protein, 222 aa, Homo sapiens
MRRSGEMLKPLVEKRRRDRINRSLEELRLLLLERTRDQNLRNPKLEKAEILEFAVGYLRERSRVEPPAAAAPGVPRSPVQDAKALASCYLSGFRECLLRLAAIAHDASPTARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 783613 - protein, 232 aa, Homo sapiens
GAMVTRDRAENRDGPKMLKPLVEKRRRDRINRSLEELRLLLLERTRDQNLRNPKLEKAEILEFAVGYLRERSRVEPPAAAAPGVPRSPVQDAKALASCYLSGFRECLLRLAAIAHDASPTARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 783614 - protein, 98 aa, Homo sapiens
PALGVSALSCPQSLATSPPWTSPSPDEEPMMAPILVEAWTFSLALRPCTAGLILLSQHTPLLWAAPWGAQTTACVRKASARTAPSAGMPFLHPHSVSP

SEQ ID NO: 783615 - protein, 250 aa, Homo sapiens
MPELNRLLYIYQITRLRISKVPFICLLQILPRLKQEGGLSPEGPDCSERTMIVYCTPGLGDRVSNKGGKMKLGEGKREKWGEGKRQDPKKGDRDPETGKGREPWRVEAGGSGAHAMRAGRHPHPLLHRDPRTVLFSSQAPPHGLQHTKQGAAAGLPGPGGPQRPQEPAVHLNLLSVPNPRHSVAPAFLGRGSPTFSYSQQCPNPLKSSKAADWEPRYVQPPGPQPHWKQEKEGTPGSDGRVKPHGAQGPG

SEQ ID NO: 783616 - protein, 181 aa, Homo sapiens
MKLGEGKREKWGEGKRQDPKKGDRDPETGKGREPWRVEAGGSGAHAMRAGRHPHPLLHRDPRTVLFSSQAPPHGLQHTKQGAAAGLPGPGGPQRPQEPAVHLNLLSVPNPRHSVAPAFLGRGSPTFSYSQQCPNPLKSSKAADWEPRYVQPPGPQPHWKQEKEGTPGSDGRVKPHGAQGPG

SEQ ID NO: 783617 - protein, 82 aa, Homo sapiens
KMSRKLSLEKTSLIVSSSDTAARKDSGWLVDIQAKDPENHRLNPKSSEVYSKDSKQATFTSGASGSQNRGGGQAQLNCHSRV

SEQ ID NO: 783618 - protein, 150 aa, Homo sapiens
MWHPRSCSCLGSRHTRLSCVVAEEQFPITSVFSSTSDSAVAFLRHLHHFLQQNSLAPGSDSRRLSQAAGTGTRGCHTQLEEQEAPAPTVYSGTSSCSSEKPVRPQLTPVLVPPHALTYTRAHVHTCMLQACVGGLRCVGVHPESGQKSHL

SEQ ID NO: 783619 - protein, 36 aa, Homo sapiens
MEVDLTHRREERFSQHQWSLPSNPHATFRGPQHRRH

SEQ ID NO: 783620 - protein, 68 aa, Homo sapiens
MGNRAEGFTVRDWIFWQSPFLKLGFPIIKGGRFFEQIQTWGMGQRSGTSIVPAMVVVQVYTSRGPRWA

SEQ ID NO: 783621 - protein, 823 aa, Homo sapiens
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNFKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKAENEFLTEQLSETQIKFNALKDKFCKTRDSLRKKSLALETVQNDLSQTQQQTQEMKEMYQNAEAKVNNSTGKWNCVEERICHLQRENAWLVQQLDDVHQKEDHKEIVTNIQRGFIESEKKDLVLEEKSKKLMNECDHLKESLFQYEREKTGGVVSIKEDKYFQTSRKTI

SEQ ID NO: 783622 - protein, 246 aa, Homo sapiens
MKLFGFGSRRGQTAQGSIDHVYTGSGYRIRDSELQKIHRAAVKGDAAEVERCLARRSGDLDALDKQHRTALHLACASGHVQVVTLLVNRKCQIDVCDKENRTPLIQAVHCQEEACAVILLEHGANPNFKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTK

SEQ ID NO: 783623 - protein, 104 aa, Homo sapiens
PGVVQMPKAGRHQAAALQHTGQGCDVSRPVQTPACGGRMQHSTESQRLDREPEGWVTCHLSPCGPGIMCFPRTPRIRSPREDSADHMLRCALRFYRQVGCRLPG

SEQ ID NO: 783624 - protein, 170 aa, Homo sapiens
DFYTLPVGIRTVAVTKSQFLINGKPFYFHGVNKHEDADVCWGSWVLVGAASGHPPLSPSLCPAVEGSSGQMRQMAPNGEGAHGVALQGPGSQRKCSFDRDRGHLALLSPEIRGKGFDWPLLVKDFNLLRWLGANAFRTSHYPYAEEVMQMCDRYGIVVIDECPGVGLALP

SEQ ID NO: 783625 - protein, 336 aa, Homo sapiens
DFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAEPIAGFHQDPPLMFTEEYQKSLLEQYHLGLDQKRRKYVVGRAHLELAILTDRTAEWGITGVSLGTNKREVLAADTDMLTGPCCRQGGTVCEDPGLSMIRSRVDHGVNGTD

SEQ ID NO: 783626 - protein, 423 aa, Homo sapiens
DFYTLPVGIRTVAVTKSQFLINGKPFYFHGVNKHEDADVCWGSWVLVGAASGHPPLSPSLCPAVEGSSGQMRQMAPNGEGAHGVALQGPGSQRKCSFDRDRGHLALLSPEIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTYESAGYYLKMVIAHTKSLDPSRPVTFVSNSNYAADKGAPYVDVICLNSYYSWYHDYGHLELIQLQLATQFENWYKKYQKPIIQSEYGAEPIAGFHQDPPLMFTEEYQKSLLEQYHLGLDQKRRKYVVGRAHLELAILTDRTAEWGITGVSLGTNKREVLAADTDMLTGPCCRQGGTVCEDPGLSMIRSRVDHGVNGTD

SEQ ID NO: 783627 - protein, 150 aa, Homo sapiens
LYTSKRFILLNAVYFSTLYTSQRFILLNALYFSTLYTSSTLYTPQRFILLNALYFSTLYTSQRFILLNALYFLAVNKFPQSVCRFTFLHPQLSPQRFILPRKSEKGEHNALYFRGSQRRGKESLLTISSTGKWGKGIILFTPASSIESSK

SEQ ID NO: 783628 - protein, 68 aa, Homo sapiens
VYASKHREKWRLHFIHPGLHTKSQIRIQEHLLENPSTLYTSEEVREGGTQRFILPRKSEKGEGITFDH

SEQ ID NO: 783629 - protein, 127 aa, Homo sapiens
RFILLNALYFSTLYTSQRFILLNALYFSMLYTSQRFILPQRFILLNALYFSTLYTSQRFIPLNALYFSTLSQRFILPRKSEKGEHNALYFRGSQRRGKESLLTISSTGKWGKGIILFTPASSIESSK

SEQ ID NO: 783630 - protein, 156 aa, Homo sapiens
LVLVALETTGEAVVMAHRFSPVASPQDPWASSNFPVLLLKINRCLHQPSSFQKLWMRSNLPPKARAHLQSFNPKQKEASVFSPQMSLNSPPESLNASHQGSHTCSWFFLRQSSSSFRDSSWASRSHLARVRLSSTLRRPQMSASTSCCSERSLSYL

SEQ ID NO: 783631 - protein, 156 aa, Homo sapiens; identical to SEQ ID NO: 783630

SEQ ID NO: 783632 - protein, 53 aa, Homo sapiens
SAPKKDDKTQCPSSTQGRPSSGGVNPLTFTCFHLRLWSMISAMNYQHSQINQA

SEQ ID NO: 783633 - protein, 132 aa, Homo sapiens
NSHFPSSPVISLCSSEDKPLPAQPSSFQKLWMRSNLPPKARAHLQSFNPKQKEASVFSPQMSLNSPPESLNASHQGSHTCSWFFLRQSSSSFRDSSWASRSHLARVRLSSTLRRPQMSASTSCCSERSLSYL

SEQ ID NO: 783634 - protein, 84 aa, Homo sapiens
LSDLLFTGDTVGQQTKVDVSLPVESKPDQQMFLACYSVCCVVAVIGPRCGGLAGPQEYLGALGIQLNTPIWTLRVVGMPLAVIC

SEQ ID NO: 783635 - protein, 103 aa, Homo sapiens
AAHMTWILAGLGHISVCHITFSNPNLHSYTIMEETNTQMACASKVKIGAKSKKAAAEGKGRSGEDFFQKAKGGRKSLLHKESHDLDSSWTLPHICLPYNLFES

SEQ ID NO: 783636 - protein, 64 aa, Homo sapiens
RIPGITSGAWGRGQGQSSKHVECQLPDGTPICPLLRGATQTPAGLEAHLPEVALIKKQPVLLPL

SEQ ID NO: 783637 - protein, 66 aa, Homo sapiens
GRSRGSRNGGSYPPDTATGMNNRQATKKAGKIHNTPDTATALCSYPSYLAKCIFLLKSLLPLWPLL

SEQ ID NO: 783638 - protein, 175 aa, Homo sapiens
MGGAPTEEGLIIGARYHARVFLCSTQRGPPLYGGGVLYNPHRALGAGSVLNNGVAVTLGKNRARTRLGRISFWGERESPPYISSLGGRWAAQYLFVRHQHSTLQPRDNFYARPSRREQSFTLFVTRCLLSVWLTHLKRVAYYPFRRPAKKVFRPQRGDCCTRQEQFFLYPRDYLC

SEQ ID NO: 783639 - protein, 94 aa, Homo sapiens
DDTNEWKHIPCSWMGRINIVKMTILPKAIYKFNTIPIKIPPSFFTELEKTILKLIWNQKGARIAKARLSKKNKSIGITLPDFKLYYKAIVTKTA

SEQ ID NO: 783640 - protein, 106 aa, Homo sapiens
ERKNRPSYLLYLEVIQMLSDESVSESCFCANYKEEKQDLKERIWGTPALLNDTIKPYSGKWIDTQDQKTCFLMTISTCSCIIDMFYEAVQEFPRGSVTFTHHPLLC

SEQ ID NO: 783641 - protein, 207 aa, Homo sapiens
ETSGGGRRPARVYLAPCRAGRGIRHIGAGAEGALEPRREAGGGGGPGLDREGVGSALARKAGELMSLSGKSPPRPLPPLSAAGTRLGAGCGSGSGSGSDRMFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHS

SEQ ID NO: 783642 - protein, 34 aa, Homo sapiens
TASAKAQRWEQLGVFKEEQKVKRREGWVSDALER

SEQ ID NO: 783643 - protein, 104 aa, Homo sapiens
EQPGQSPRGPGRVPVMQGGKQATSGDRTSVRGLEEQVGGFQCVWKMRFPGLADGSCEWESSQHPFQIPLVDRDPGLSVDQGTEAAPTRAPRLQPGLLGGRPLPV

SEQ ID NO: 783644 - protein, 59 aa, Homo sapiens
KGPQLDTQVPPRHAHAFLSSPRSLISKHTHWIFPARFLMNAIAMFTRILSFKNWELMKN

SEQ ID NO: 783645 - protein, 148 aa, Homo sapiens
SYGDSFVFYKTGTWCKKMWTAGLERSQMSPPNIQRPLYCVPELGWPQESILSRFFLPSSLLPSLLSFLTSKLRSRYVAQSGLQLLASSNPPSSLSLPSSWDYRHVPPRPANFCIFSRDRVSPYWPGWSRTPDLVIHQPWPPKVLGLQA

SEQ ID NO: 783646 - protein, 85 aa, Homo sapiens
PCCPHHRPAWYDLPPPPYSSDTESLNQADLPPYRSRSGSANSASSQAASSLLSVEDTSHSPGQPGPQEGTAEPRDSEPSQGTEEV

SEQ ID NO: 783647 - protein, 162 aa, Homo sapiens
LEGWFINFCAIFPNKLQANQRQYTGQYGVCSAATPWIGEQAFWPNHGIKEIYDTLLQLSSQTLARLLNCNFQKTFLIIPSGVMSNSTYMPMERKDTCFGRDWKHWATKQNFHHNLDCRCHLPDTGVHSCTGRIRRDKRWGKHLSTNFTGLCLVSQFSRGLQP

SEQ ID NO: 783648 - protein, 145 aa, Homo sapiens
AARGTCLPSASGGAARGTCLPSASGGAARGTCLPSASGGAAWGTCLPSASGGAAWGTCLPSASSGTAWGTCLLPNPRFLLSWFPLGSYLRLYLVAVGVSLVSCSVHRGWCRLSFIKHLLTGRNGSGCWVMVSTLPRMGLPQKVKE

SEQ ID NO: 783649 - protein, 58 aa, Homo sapiens
MIRPTTPHLRCIWWEKCVRRTKKCNVEPSKDSQCYVENLNRLPEWPSLREVTLKLTVE

SEQ ID NO: 783650 - protein, 118 aa, Homo sapiens
LVLFREAIEHITRIVRVIGQPRGNMLLVGIGGSGRQSLARLASSICDYTTFQIEVTKHYRKQEFRDDIKRLYRQAGVELKTTSFIFVDTQIADESFLEDINNILSSGEVPNLYKPDEF

SEQ ID NO: 783651 - protein, 46 aa, Homo sapiens
GQRFLGPYSTVIKTELSQADRTLNKASGAGEFPEPPISIIVDAFLS

SEQ ID NO: 783652 - protein, 108 aa, Homo sapiens
YCSVSLLLCPALVSVTLPAPLIFNYSFLVSFVGSISFLCPLSHFILSHFPASFSSFLEALSSLILLLSKENFIRTLSFFELSLGPKSTSNCFLGSLDVPQVLQAQPYK

SEQ ID NO: 783653 - protein, 104 aa, Homo sapiens
MPPTFFWSQSLALVAQAGVQWCNLRSRQPLPPRFKQFSYLSLLSSWDYRYVPPHLANFVFLVEMGFLYVGQAGLKLLTSGDPPTSASQSAAITGVSHRAWPTHD

SEQ ID NO: 783654 - protein, 65 aa, Homo sapiens
MSRSPLHPASSRPFQGLCSWPGVVFSLLTWLTVTCPSAGDHVRTPRPAHCCSLALSRPWRVPVIA

SEQ ID NO: 783655 - protein, 66 aa, Homo sapiens
LSGRAPHLSPSRVDGATPHGSLLTSPARGRGASSPPTSFMLGSEVDVEEKGVCFILGSTAPLFKVT

SEQ ID NO: 783656 - protein, 104 aa, Homo sapiens
PGALNPPGALNPPGALNPPGALNPPGALNPPGDLNPPGALKPPGALNPPGALNPPLTLPGALNPRREPLTLREPLTLREPLTLKSHKLQRALLQKSPMGSKAKE

SEQ ID NO: 783657 - protein, 67 aa, Homo sapiens
YNSSVTTAPVTTAPVTTVPITTAQLQQLQLQQLQLQQLQLQQLLEAKEFENSLGNIVRLSTKKFLKN

SEQ ID NO: 783658 - protein, 865 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 783659 - protein, 865 aa, Homo sapiens; identical to SEQ ID NO: 783658

SEQ ID NO: 783660 - protein, 906 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 783661 - protein, 309 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKPNSII

SEQ ID NO: 783662 - protein, 261 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPFEIV

SEQ ID NO: 783663 - protein, 318 aa, Homo sapiens
MKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTNEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 783664 - protein, 1214 aa, Homo sapiens
KGLKLLALAAVSRRRPRSLTLRQDGGGCAHVTVLKYCGGPLPRGWEGRQDEVGFPRTVSGRGPPPQLRGASVSPATGGGGNSGEQPWAAGFLPTPESPAHRRRGRAPEPSPHAAARPGSLLIPEQSTMTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGEVGTGQYATTKGISQTNLITTVTPEKKAEEERDEEEDKRRKGEEVTPISAIRHEGKSPGLGTDSCPLSPPSTHCAPTSPTELRRRCKENDCKLPGYEPSRAEHLPGEPALDSDGPGRPYLGDQDVAFSYRQQTGKGTTLFSFSLQLPESFPSLLDDDGYLSFPNLSETNLLPQSLQHYLPIRSPSLVPCFLFIFFFLLSASFSVPYALTLSFPLALCLCYLEPKAASLSASLDNDPSDSSEEETDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 783665 - protein, 316 aa, Homo sapiens
AEARCRWQLGGAATAAAGGARVWRPLPASRSSFPPPSPRLDLGEFEGKSPCGGTCEQPYLSLPLRYFFSPRKVVPAGCEQAPGGAPKEGFGDSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGS

SEQ ID NO: 783666 - protein, 295 aa, Homo sapiens
MDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 783667 - protein, 318 aa, Homo sapiens
MKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 783668 - protein, 78 aa, Homo sapiens
MSGSRVPGRGGNHEGSFLTTRKGLYSSHQEARCSLRSAAGQDLNHSLTQTPLARSHPGFHYREEQQRLHPPAGWSAAE

SEQ ID NO: 783669 - protein, 72 aa, Homo sapiens
LVSGALGNGSKPPAFQPRARNGKNCEIGYLKPAPCFPGPLTIASSDHPGVAFIPSPCSRDPCVVGTGGHFLP

SEQ ID NO: 783670 - protein, 132 aa, Homo sapiens [sequence omitted]

SEQ ID NO: 783671 - protein, 229 aa, Homo sapiens
ELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSCLRQGS

SEQ ID NO: 783672 - protein, 227 aa, Homo sapiens
PTLRRWEKGGWGGQGPLRGASLVNPAPISGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSCLRQGS

SEQ ID NO: 783673 - protein, 227 aa, Homo sapiens; identical to SEQ ID NO: 783672

SEQ ID NO: 783674 - protein, 390 aa, Homo sapiens
ELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSVSTMLVGKGADGRRKGCGETEAEVGYGAQLECLSLELSQARLLTSFLPAQLLRLYQLMLFTLPGTPVFSYGDEIGLDAAALPGQLWRLQSCCGMSPASLTSRAVSANMTVKGQSEDLVLLSCPAVSDQRSKERSYLAGDFHAFSVGLDLFYSGLGTDEVPGGSLGVG

SEQ ID NO: 783675 - protein, 109 aa, Homo sapiens
VTWLVILEQPSNPGRLARDHVVIVLDYRWADGGSNRSFPGGGRTRTGALIFTTVSSKHHRHGHGRQRGCAGHFSRCESSLATLRTGRVSQELKDEWEPATVGWKSLLGG

SEQ ID NO: 783676 - protein, 149 aa, Homo sapiens
SSSLFAEHKDLTPAWFLGVPIMGFCPTHPVLGTSTACLTISIQVRPGLLRAGLGSPAKRSGYKSMRDFVLVKNLGPVARPLSGPHLNHVYWASSWALPPMQGCLFLLMSCDEKEMLDIHFPSRIPLSLSSIFIDPMLFLNIHESRIRYI

SEQ ID NO: 783677 - protein, 119 aa, Homo sapiens
GVRSSTLTEDWIHLLGDRMKVVLLLNSLSLAAPTEVHVERIPPSMSRMVCSTSPLKGTSTVFPSEALKVGKTLLSSPSGFLKPGLAMSGQVIYGKTLYMQFCYEPKTALKIKSMATRGG

SEQ ID NO: 783678 - protein, 127 aa, Homo sapiens
EWGALLSQPRAEPSLACRFLLLLLWKSRSKIPALGWLSFLLRGMWGYYPAGQTSSPFNDNNDNLHLYKAFHWGILIVSQTIINSPLQVWQSAKQEPLYSAGEGCFPGPATCWGSPTYLTPTHPQGLA

SEQ ID NO: 783679 - protein, 111 aa, Homo sapiens
YGARTRRTAVSREYDTFHRISPLLFYPSSHDCPACTSFICCGSDAGFAIKHVFNPNHATFWQPSMVLDWCEDSIKLVPIPHYLVKAQALSISTKPFLFVHLFIRNILYSNL

SEQ ID NO: 783680 - protein, 159 aa, Homo sapiens
GRHSGGSRSPLPPPHPPCCPRAREGMRQIGEGPDPPKNLNTKLQMYFQSPKRSGGGECEVRQDPRSPSRFLVFFYPEDVRQKVLERKNHELVWQGKGTFKLTVQLPATPDEIDHVFEEELLTKESKTKEDVKEPDVSEELDTKLPLDGGLDKMEDIPEE

SEQ ID NO: 783681 - protein, 112 aa, Homo sapiens
IQRIPLCLTHRLQTCRSLGDRHLQIRIGLGTACVVDLWLEGIWSTLENSARSCVSWAQSWRGGTDAPSNLAAFVRCYCLYSEKSVEEGVVQHLTMEPHNHIAFWDHTLPSEE

SEQ ID NO: 783682 - protein, 438 aa, Homo sapiens
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 783683 - protein, 438 aa, Homo sapiens; identical to SEQ ID NO: 783682

SEQ ID NO: 783684 - protein, 438 aa, Homo sapiens; identical to SEQ ID NO: 783682

SEQ ID NO: 783685 - protein, 379 aa, Homo sapiens
MVQWKRLCQLHYLWALGCYMLLATVALNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 783686 - protein, 301 aa, Homo sapiens
AAAAESSPFVERLLLKGYEVIYLTEPVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 783687 - protein, 438 aa, Homo sapiens; identical to SEQ ID NO: 783682

SEQ ID NO: 783688 - protein, 438 aa, Homo sapiens; identical to SEQ ID NO: 783682

SEQ ID NO: 783689 - protein, 473 aa, Homo sapiens
TARYRSILTRREALKDCVLLHLPCARSPPVSHSVTMVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 783690 - protein, 229 aa, Homo sapiens
MEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 783691 - protein, 100 aa, Homo sapiens
TDSAGAHSLDTGSKVKTGLAGSVFLNFLGTGDKGGGDRAVSPAHLQEIVSLRSPRQQTRARGSAFTGRWAQWLSPGSRRGGDPTLRVEAKAGELPLSTQR

SEQ ID NO: 783692 - protein, 69 aa, Homo sapiens
ARESKCSPSLLSCSPGPQRASLLDAPQTQWVPWSQCLSLTLLSWSLAPCGKPGLQRWLLTSIRGHVAAA

SEQ ID NO: 783693 - protein, 115 aa, Homo sapiens
LETSSDFILRPTLKVLVLTPHFKDKNQPLNQDKGLALLRISSSFGLTPDPNVVEAGTPREQAESGGSTAGRRPGWGHPQASRRSRVPGESGRAVSTRDSSPGRSRHPPTTARAGR

SEQ ID NO: 783694 - protein, 70 aa, Homo sapiens
MVPVCRRQPSYCRIEWLTCMYLEQKKEMPGSPALCSKYSSAFFYIPLFLRTSEMGRCLLSPATCYAFSIL

SEQ ID NO: 783695 - protein, 540 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKYVENKIDEF

SEQ ID NO: 783696 - protein, 554 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNRKLFAASKNVRRKAASILSDTKNMEIINSTIETLAPDSPFDHKTVSGFQKLEKLDPIAADQQDTVVFKVTEGKLLRDPLSRPGAEQTGIQNKTQIHPLMSQMSGSVTASMATGSATRKGIVVLIDPLAANGTTDMHTSVPRVKGGQRNITDDSRDQPFIKKMHFTIRLTESASTYRDIVVKKEDGFTQIVLSTRSTEKNALNTEVIKEIVNALNSAAADDSKLVLFSAAGSVFCCGLDFGYFVKHLRNNRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNPIVLEECKALVRCNIKLELEQANERECEVLRKIWSSAQGIESMLKIPLLGYKAAFPPRKTQNDQRWCP

SEQ ID NO: 783697 - protein, 76 aa, Homo sapiens
VPSHSFTQHDASLFNTCCGSLGIKAESEASAHTWGQGRGWREPGSSHPDGVAEASPFTSVGLIYEMRSMLCCCASC

SEQ ID NO: 783698 - protein, 71 aa, Homo sapiens
MAVGELCDRGPGPTPAELSKNGPARLWASLYDSLDLRVPRTACMPKKPNLSLIEALALPAYRRHRGVTRFL

SEQ ID NO: 783699 - protein, 103 aa, Homo sapiens
MNHLQAETGAVCHMAPLGLSFLSCFFGKAHLLSRLGLLPRPSKTYSWGLGPVKPLALGRSLEPLRRGQAPRPASCRPAPGGTALAGLGPRAGGAAPGSGLQRP

SEQ ID NO: 783700 - protein, 79 aa, Homo sapiens
MGSAEGDAAQGLLTNSLVWLYLETGMDTMTSLDYAWPEVLIGDFLTPSSTSYCEPGHSSIMVCGCFFPPEGSSASCSLC

SEQ ID NO: 783701 - protein, 103 aa, Homo sapiens
MDRCRGIMGFPTGPVISHVGKREELLPHGVCAWEGSRAEKRHFFCPPGCFRQMKTWAGRARNKEESRVLSTQRERMQPGHLTPADHTTSSASSPHLLRLQLPF

SEQ ID NO: 783702 - protein, 61 aa, Homo sapiens
DLGKGRRGIPSVETQTASETPTQPWAFSSCQCPPDKFLGHLCTRRGVSPAAPKTDFAISSP

SEQ ID NO: 783703 - protein, 69 aa, Homo sapiens
PEPYLFSPTAALPSAPRTQFLPTAAHPVLQNPVALAAFLLPGRLGIGCPVPVLKAARVHPGKVPPHMVS

SEQ ID NO: 783704 - protein, 101 aa, Homo sapiens
PSQRGFQSHPLKSSSPLFTCVNPARRCGLRDPSCNQEVRPPPGPGGHLRPAVLEEECFLPAVPTDGLAPHCGDMHHALCGPLFFIPEFIPHRMVQLSYLAI

SEQ ID NO: 783705 - protein, 350 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 783706 - protein, 350 aa, Homo sapiens; identical to SEQ ID NO: 783705

SEQ ID NO: 783707 - protein, 350 aa, Homo sapiens; identical to SEQ ID NO: 783705

SEQ ID NO: 783708 - protein, 271 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 783709 - protein, 350 aa, Homo sapiens; identical to SEQ ID NO: 783705

SEQ ID NO: 783710 - protein, 350 aa, Homo sapiens; identical to SEQ ID NO: 783705

SEQ ID NO: 783711 - protein, 350 aa, Homo sapiens; identical to SEQ ID NO: 783705

SEQ ID NO: 783712 - protein, 350 aa, Homo sapiens; identical to SEQ ID NO: 783705

SEQ ID NO: 783713 - protein, 350 aa, Homo sapiens; identical to SEQ ID NO: 783705

SEQ ID NO: 783714 - protein, 350 aa, Homo sapiens; identical to SEQ ID NO: 783705

SEQ ID NO: 783715 - protein, 350 aa, Homo sapiens; identical to SEQ ID NO: 783705

SEQ ID NO: 783716 - protein, 350 aa, Homo sapiens; identical to SEQ ID NO: 783705

SEQ ID NO: 783717 - protein, 350 aa, Homo sapiens; identical to SEQ ID NO: 783705

SEQ ID NO: 783718 - protein, 350 aa, Homo sapiens; identical to SEQ ID NO: 783705

SEQ ID NO: 783719 - protein, 350 aa, Homo sapiens; identical to SEQ ID NO: 783705

SEQ ID NO: 783720 - protein, 350 aa, Homo sapiens; identical to SEQ ID NO: 783705

SEQ ID NO: 783721 - protein, 124 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAASREAPART

SEQ ID NO: 783722 - protein, 350 aa, Homo sapiens; identical to SEQ ID NO: 783705

SEQ ID NO: 783723 - protein, 234 aa, Homo sapiens [sequence omitted]

SEQ ID NO: 783724 - protein, 132 aa, Homo sapiens
ESDSTGPNVISCMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 783725 - protein, 350 aa, Homo sapiens; identical to SEQ ID NO: 783705

SEQ ID NO: 783726 - protein, 70 aa, Homo sapiens
IQHTFGARAQSGNMNMARSGNHKRYLVHKMYAAVRISSPQIKEERHSSWVKPDDVSGTKVTALDAPDVIL

SEQ ID NO: 783727 - protein, 350 aa, Homo sapiens; identical to SEQ ID NO: 783705

SEQ ID NO: 783728 - protein, 350 aa, Homo sapiens; identical to SEQ ID NO: 783705

SEQ ID NO: 783729 - protein, 350 aa, Homo sapiens; identical to SEQ ID NO: 783705

SEQ ID NO: 783730 - protein, 350 aa, Homo sapiens; identical to SEQ ID NO: 783705

SEQ ID NO: 783731 - protein, 350 aa, Homo sapiens; identical to SEQ ID NO: 783705

SEQ ID NO: 783732 - protein, 118 aa, Homo sapiens
CTLFFLKQTNKQKKNLPSSVSFRRPSPALPCCGKFSFGLRCWCHICCMSSGGSHPTAEICHRLEPSLQKQHLKGIQGSQFWGRLNLQLHLPCKLETGKASLTSIFLFCKMEIRPSWKG

SEQ ID NO: 783733 - protein, 131 aa, Homo sapiens
KTQEQEKKTWDQEEKMREEERMREREKKMREEEEMMREQEEKMQEQEEKMQEQEEKMWEQEEKMWEQEEKMWEQQRLPEQKEKLWEHEKMQEQEKIWEQEEKMRGQEENMWGQEEKMWGQEEKMWGQEEMR

SEQ ID NO: 783734 - protein, 159 aa, Homo sapiens
MKEAKDARYTNGHLFTTISVSGMTMCYACNKSITAKEALICPSKVVLDPESHPDSVPTDPDLFICFFLPGSMRVTLLSDPQLGPNARASCLIPCSLSSSEGWWLLEYGISRTIWECGGGEAVAPFCTVIHQAPPFAPEQLLKVRGKLIGERTRMFVCVE

SEQ ID NO: 783735 - protein, 116 aa, Homo sapiens [sequence omitted]

SEQ ID NO: 783736 - protein, 95 aa, Homo sapiens
NNYNGPAREPPSIALGYANSGCKLLEDMVEKTINSDISIPEYKELLQEFIDSDAAAEAMGKFKQCFLNQSHRTLKNFGLMMHTVYDSIWCNMKSN

SEQ ID NO: 783737 - protein, 41 aa, Homo sapiens
MSESMKSAQHGAGRQGTGCECCWGDGGHGEMGKPWSQGTWI

SEQ ID NO: 783738 - protein, 79 aa, Homo sapiens
KVYTPHVSHVDSSNTQALQVAMVPPSYSSQPYQSTHPSTNPTLVDPTRHLQQRPSGYVHQQAPTYGHGLTSTQRFSHQT

SEQ ID NO: 783739 - protein, 76 aa, Homo sapiens
QGTSPRQSESERLPRAGDIAAADLTWEGGVSSQCGGGNSKRELDMQRHRSGQLAALGKQPIVVHGEEGGQGRRGRA

SEQ ID NO: 783740 - protein, 84 aa, Homo sapiens
GVQRIPQALLTSILDQITKKSHSSLISQMLHTLKSTTQLQRKYEAEKKRRCETENVIEDGQLYKFNGHYVEEYWKYAHVKLGSG

SEQ ID NO: 783741 - protein, 66 aa, Homo sapiens
ISSNPMSLSSTLESFFLATGPAPPARCEALHSAVRETQSTGCQPNASHRDMELLDISAPSHLVLSV

SEQ ID NO: 783742 - protein, 116 aa, Homo sapiens
VIPVRCELENSKHASHIACQCLTHSCLLNMFYMLSLSHYPCFPTFHHSKGSNLAFCVKSSSDATHLRAECTDVVLPCSPTNPWLFIPPPTWHCQLLSTCISALFHWHTSLKSQTLS

SEQ ID NO: 783743 - protein, 107 aa, Homo sapiens
MLSLLVWLTGMVKPLKEGTQKFLWTLGHLHSGESKGLKENWDGGELEDGVVFPKTSPDLAIPASPRPSQDPATKSITLVTRRLRLAYVLMGGDVGVRWGVYGNTITN

SEQ ID NO: 783744 - protein, 36 aa, Homo sapiens
TALLSDLAALQLALNQGDLAALGGSIHLWLPPSKDP

SEQ ID NO: 783745 - protein, 35 aa, Homo sapiens
ESTWCSYIKYQHARKNPSFGFGFPSKLEVDSGASF

SEQ ID NO: 783746 - protein, 131 aa, Homo sapiens
MIPQMLDDDVMWHCARLLIIGSRGHSMALRRRTGGSSFLGAALKGWEMGPGSGPMGLAICGARNGALLWHRGPKTRRGRAQAQTRRGTQLGPPETSARAGQNKRPKALGEHHHGKQHSTEKQGTRNTTRGK

SEQ ID NO: 783747 - protein, 130 aa, Homo sapiens
MTTACSLLHRLGSKILPVDLHIFYFLRWSLALSARLEWCNGTISTHCNLRPLDSSDSPASASASHVAGIIDARHHAWLIFVFLVETGFHHVGQAGLELLTSSDPPAPASHSAGIIAVSHRAQPTCTFLTF

SEQ ID NO: 783748 - protein, 162 aa, Homo sapiens
EQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIEFCSAPFWGVVADRFKKGKIVLLFSLLCWVLFNLGIGFVKPATLRCVPKIRPTTHPTNASHQL

SEQ ID NO: 783749 - protein, 165 aa, Homo sapiens
RHLLSFCGAVAMKVELCSFSGYKIYPGHGRRYARTDGKVFQFLNAKCELAFLSKRNPRQINWTVLYRRKHKKGQSEEIQKKRTRRAVKFQRAITGASLADIRAKRNQKPEVRKAQREQAIRAAKEAKKAKQASKKTAMAAAKAPTKAAPKPKIVKPVKVSRFPSW

SEQ ID NO: 783750 - protein, 69 aa, Homo sapiens
MKLGLEGPVALQQQLILHLHVHTLLLPFMGKLGIRLVTSLSLIIKSHGFCANSVSEVYVSICSIPSPFP

SEQ ID NO: 783751 - protein, 30 aa, Homo sapiens
MAEHVGLSPVRGGTQRGGWGRMGVKVAGDA

SEQ ID NO: 783752 - protein, 35 aa, Homo sapiens
LLQQREFEDRHPSSRAHSGDPVGGAPLAPPSLPVS

SEQ ID NO: 783753 - protein, 89 aa, Homo sapiens
SSAETVHLMQCGESTAEQPSVWGGAQWDQEGRRAGRGSKREKEDRGEGQRASSHFRSQLPEHFTTSAFCQSAHLKAESSKAPLLRKGGE

SEQ ID NO: 783754 - protein, 103 aa, Homo sapiens
MCLSGREQPRPSEARFQHLGCSQQPNCFLGFIYKGFFWYHKGGWTGLPLLPGGSGSFRGRSQLATGVTALRRPMWPASIPVLMAKDRLLLCSAGLEVIWSSGL

SEQ ID NO: 783755 - protein, 149 aa, Homo sapiens
METFSCKGYGGTPAIGISPCLLQHGNILRDLPGLSRATSECKGKECSSRKGMCLSSHHLRARPVPGSAGFLHQHGLFISNHWEGMCAESCQDGKAHVPILTAAERKMAAEGKQQQKEKFDSDGLRGQWQAILVHVSCISESRFVAQAVA

SEQ ID NO: 783756 - protein, 109 aa, Homo sapiens
MLAGQELSTPQMLPGPFRWRSPGCDSQVARGELLEGAGEKGGDPVGCVSGGGLVGAPRPAHTTGLRIHSSPPVHVSAPSTPRAWGPSCAILRPPPGPRAGCPQPLHGGR

SEQ ID NO: 783757 - protein, 102 aa, Homo sapiens
LGWAGAASHCPSPRAGMQGGQPQGTCPSPCLLWVGRLLTEPPGGRALTFRALQRVCQMLEMPPGPVHQPSSFRCLHESPLGPLLGLGTRRSCPVRFLLKLLF

SEQ ID NO: 783758 - protein, 91 aa, Homo sapiens
TRLRCHTSSEPCHCNLSFLSPLQEPLTPHPGMPRRTTSFRLLQCNYLRPPWLFLDLTDTQNSCSWTTFDFNSHNLSSSQFSSLVVPKPLLL

SEQ ID NO: 783759 - protein, 40 aa, Homo sapiens
PALLSLIPKVDKGKNRPAFVTNTDIKFSNIRTSNLDLAIC

SEQ ID NO: 783760 - protein, 130 aa, Homo sapiens
LSLSGGHYLKASGVSPPDRHFLKASGVSPPDRHFLKASGVFPPDRHFLKVSGVSPPDRHFLKASGVFPPDRHFLKVSGVSPPDRHFLKASRVSPPDRHFLKASGVSPPDRHFLKASGVFPPDRHFLKVSG

SEQ ID NO: 783761 - protein, 96 aa, Homo sapiens
LTPEADRRQQRGFYASEARCSLRSTFTTAGLGEVKHLCNENYKTQLKEIREDTNKWKNIPCSWMEESISLKWLYCPKLFTDSMLFLSNYQRHSSQN

SEQ ID NO: 783762 - protein, 116 aa, Homo sapiens
IPTHHPGTGEARLLAAKGENFLRLHPLLPVHRLVGDSPGTFPLIFLLHRSLLCSRHCINNFICSFLCQRSLTKKTSSKVSEHTNSGVYISQQGHMVHPPRKKPCWLSVSISTPTAL

SEQ ID NO: 783763 - protein, 121 aa, Homo sapiens
VKFHLKKKEKKKEMSTHPSSPTPKSLPLIELSVPQGFCQSPDPSSLNPAHQGCVQTRLCHQTDRSSWAGCVLHSAWHGLDTEETDCVSTMPSQCLLETLFPVFPQVTLQKVLLPGLGGRSL

SEQ ID NO: 783764 - protein, 105 aa, Homo sapiens
RTVSPFVFQSTQTLLSQVCPCPNVDSCQALFLSLLVTLPQALTCPQQGQCGVIAGSAICLFFLLLLTPIGHDLISIKSRNSGSWSVCYVTLSIFREELHTFCKCS

SEQ ID NO: 783765 - protein, 67 aa, Homo sapiens
AKLSKAGEFHEVHGYDDRELSQTHTKPLPKRGSDRRKSTRMRPCGTLRRTDGTLGCFSTVAPFMVVL

SEQ ID NO: 783766 - protein, 73 aa, Homo sapiens
ELQCAGYTPIACSELCCWSPAPTNTPQLSFFSLPKRLLYVLFWSQTLALEKVSETSLGEEKVDSGIRRFRFDF

SEQ ID NO: 783767 - protein, 146 aa, Homo sapiens
HHLSLPLLELQAHDNTPGYFFLIFQTGSPYVAQAGLKLLYSSDPPPSASQSDGITDVSHLSGSSDSLTSASQVARTTGTCQHACLIFVFLVEMGFHHVNQAGLKLLTSSNLPASASRSAGITGMSHFTRPRLILKIFVEVVSRYFV

SEQ ID NO: 783768 - protein, 167 aa, Homo sapiens
PCLSLPNSWDYRHVPPRLANFCIFNRDGVSLVGQAGLGEQSLSVEIRPASWPPASLPPAFLCFAIWGLRMWGGVFPLRDEASPVDHSEACQSQLLCLAFSSRSLRMIRSGELPFLETQHVSFPHSGVLHVAGVLDSAGHGWVELCDSGVLRVAGMLDSAGRGWVELC

SEQ ID NO: 783769 - protein, 104 aa, Homo sapiens [sequence omitted]

SEQ ID NO: 783770 - protein, 146 aa, Homo sapiens
RDPQVCPELAPDTKRQELAGTSQPAGTHPGVRGPRHQGAAAQVGGSAAMGRILPLGAAGPIVTGTPSLASRTGLGGCRRELGTQPRSRPVPAPYLAFTVAGTTPGPGGLRVPEGQPRALAWRLLGVRRHRVLSPWRPEEAAVCAAR

SEQ ID NO: 783771 - protein, 197 aa, Homo sapiens
LRLCAHLDCTPDIWALHNWSAWLTPFLRGTTRRFDTAFFLCCLREPPPVYPDLAEVVGYQWSSPSEATESFLSKEIWLPPPQFYEVRRLANFASLSDLHKFCLGRALEGLERWLPIILLTADGMVHLLPGDELYLEDSDFLENLMSTEKKTEEIMKEGKQFHRIVTYHRHLYDIHVTVQPKYKHVYPKNSVVRKSHL

SEQ ID NO: 783772 - protein, 183 aa, Homo sapiens
TCRRQLCKQPLLLSEDEEDTKRVVRSAKDKRFEELTNLIRTIRNAMKIRDVTKCLEEFELLGKAYGKAKSIVDKEGGPPVLNPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDY

SEQ ID NO: 783773 - protein, 76 aa, Homo sapiens
SGVDVRVMWAYLVRKNEMLCKNGSFSPPQAGSRRRLFSNIPCENLVKLQEVKLIMCRPLMIESSWSKTNVMNGPPN

SEQ ID NO: 783774 - protein, 130 aa, Homo sapiens
QSSLLGLSKCWEPLTGVSHHAQQSFVSQSRSLSYKKASRFSLSLSLSHTDTHTHTHTESPPPTFFSFLSFFGIFFQAENKNISHGYSFESFPLLSASIPRPPQCQSISRASVKSKTNPQRSSLTGPLPAA

SEQ ID NO: 783775 - protein, 35 aa, Homo sapiens
LTINTNSKDYKVITFPQINPFLIPIQLPSPPPLQA

SEQ ID NO: 783776 - protein, 152 aa, Homo sapiens
GGGMSGLTTGASLSCPGTGSMTLVGHWGRCYLLTERRSLPCGLTEHVFRPAPSSLADAEDARKATCLMLAWPGDRSPLGLCPVAAGLAGRGAQQWGASEWSPTFQPWGCCIGLPHVTSQALMLLLLKGVRPDGQVKSVLQGGVYPPLPGGGA

SEQ ID NO: 783777 - protein, 76 aa, Homo sapiens
AKGTSMRKSTRPWSEPSGGPGVVFLGSGGKEGPRAMGQPEGVFLRDGLFLRGLLQWPLDWVPAGMVCAQGLPPELT

SEQ ID NO: 783778 - protein, 247 aa, Homo sapiens
QGPMCARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGEPPPHPKHPACPGAPIL

SEQ ID NO: 783779 - protein, 63 aa, Homo sapiens
KASVQSSLQERWGLRVKASVQSSLQVRWGLRVKASVQSSLQVRWGLGVKASVQSSLQDRWGLR

SEQ ID NO: 783780 - protein, 74 aa, Homo sapiens
NDGPQLSAVLPPQLLKALGLYGVNHPCLYQQKYSEKTFEGNASPFLFKISQFLPNDGPQLSHGAWPQMSLLMSG

SEQ ID NO: 783781 - protein, 124 aa, Homo sapiens [sequence omitted]

SEQ ID NO: 783782 - protein, 102 aa, Homo sapiens
ELAPLVSLDTTLSKIFLMSLALGEELPPQGSQQVGGDVAHRGGVLRGLPAPADASSSLSSFTVNCCRLAGPSCGGCRSPRKTHPKITLPGFLWEAKPVWGPP

SEQ ID NO: 783783 - protein, 277 aa, Homo sapiens
QGLGCLGQTRPASPRTARESVLGVSQNMSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGSSCANSDTAVKTQ

SEQ ID NO: 783784 - protein, 336 aa, Homo sapiens
QGLGCLGQTRPASPRTARESVLGVSQNMSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 783785 - protein, 110 aa, Homo sapiens
LQLVQAGEETQVGAPARAETRCEPFTMKMLKDIKEGVKQYGSNSPYIRTLLDSIAHGNRLTPYDWEILAKSSLSSSQYLQFKTWWIDGVQEQVRKNQATKPTVNIDADQL

SEQ ID NO: 783786 - protein, 80 aa, Homo sapiens
PDANLILTRRAPPSQVDSHLKSVNPSHSFSLHHWHLMVFLFFMAPNFWFSFYYIIYVLYCNSPHNLFGKKDSIQERKNSR

SEQ ID NO: 783787 - protein, 126 aa, Homo sapiens
LCNPESRWKVFAAVSLECAQEELPCAFLGSKGSRKHFWLHFPQPRAKTRDSCCCCDQDWESDKETAVPFMTPRLRENICREDGTGPAVLGPWPESTLWTHFQLVLLATENTPQSPQHQVTAAFASL

SEQ ID NO: 783788 - protein, 112 aa, Homo sapiens
PGHVIRMQHNLSPNLDLNDSRTRALHKCTLFLSTFLTNWTDHMHTSVHDPPNLLHNRLGQRSNDQSWFSRIAQHSALTDHHHIPLSFIESLEPDKSWFKFWLALHICIMWDK

SEQ ID NO: 783789 - protein, 147 aa, Homo sapiens
MRLRHRSAAQALGSSCPSWCSQWVSASLFPSGRKQICGGGRCWVHGRALLLGSYLRAGRGSCASRRSSSSAPTPYPCIPLSPLSRWPVKSPGTSLDLTLWDRLRQGTAGCRSPRGELPSSPSPPASAFCSTSLLPPLTQENLHPYLL

SEQ ID NO: 783790 - protein, 42 aa, Homo sapiens
MQSESCTPNVPGSAIHPLLCSLPSPVSSPSCGVWVAASVLRR

SEQ ID NO: 783791 - protein, 131 aa, Homo sapiens
VGEGEALSTLQAVEGQQVAGLAVNEPLSTLQAVEGQQAADFLGGLKLYLHSNHWRGGGQLACQVGEALSTQKACGGGRGSVYTAGSGGVAGGRLVVGGEALCTLQAVKGQQACGVGVVPRPALTLRGLFLA

SEQ ID NO: 783792 - protein, 48 aa, Homo sapiens
QIPYFHSQIYLDPIPLSNISRPYTVHHLICYQPSPSHLTSSLDNCKFP

SEQ ID NO: 783793 - protein, 158 aa, Homo sapiens
FNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNTGLALEVDIPLLL

SEQ ID NO: 783794 - protein, 88 aa, Homo sapiens
IPAFLHAATETASHAELILALLRPSSDSFGGKLILQRRLPLSFSSGIPSFLWSALPPDLQIGLTLSEYRLFSGGFWPNRRQISKYQDL

SEQ ID NO: 783795 - protein, 59 aa, Homo sapiens
MAPKWVQLSTSSQPYQLSELIVIHITEQICFRRKSGSPLSSGAVVQEYHLGEKQGINPK

SEQ ID NO: 783796 - protein, 109 aa, Homo sapiens
SRFLKKLNTELPYDLAIPLLGIYPKELKTGTQTDICTPVFTAAPFPIAKPQKTPKCPNEQTKRGVYMQGDISLNGKEMLICPTTQKNLEDIMLSEISQSKRDKYMIPLI

SEQ ID NO: 783797 - protein, 115 aa, Homo sapiens
VLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARPVLAGI

SEQ ID NO: 783798 - protein, 85 aa, Homo sapiens
MAIRYPSRDAEEMNVYRSLNLGERSGLEILTWCLTAYRLCKVMKRIRTLKERKGNRGYQMNCSFQIAEGRETRRNQQKRVGKKQL

SEQ ID NO: 783799 - protein, 117 aa, Homo sapiens
ADPGDRPLRPDPRWSRTPCPAAATRPRRRTGRLRRPRLALGDPSRQAQPRRVLAGPGVPSSRGPRVAGRLSSERRWPARRRLLCGAAALPGAGMCPRRAGPTGFSGRGGSRAHRSRD

SEQ ID NO: 783800 - protein, 194 aa, Homo sapiens
TYILQSSELSVRAFCNQLKHKATQETSLDFKCSQSRLKTTKYSSQKVIGTPHAKSLVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKFPVSERKTYCVCVIKSVLKIHSLLSSNNFWFFIKC

SEQ ID NO: 783801 - protein, 37 aa, Homo sapiens
MIKVILVRSTECSGNTAILWYLGGLVPVPPQTPKSAH

SEQ ID NO: 783802 - protein, 194 aa, Homo sapiens
MHHHAPAINIFTFFWRDELSLSCPGWSQTSGFKQSSHLGLPKSWDYRREPPRSACCLLLSGTSTHGVPYPRGDLKVNDMLSAQAGTWLSVPPEFEPIAAVPDHPLRERLSTPLSPARLLHGGSLRAPRTQEHKSATLPSHSLASAYPGRQSLGCTQPRTAKLRAMIVCGEMAAGVSHILSGKAFLRARQARRQS

SEQ ID NO: 783803 - protein, 174 aa, Homo sapiens
WQGCGEIGMLSHYWWKCEFVQPLWKTMWQFLKDQEPEIPFDPAVPLLGIYPKKYKSFYYKDNMHAYVHCSNIHNSKDRKSTQMPINDRLDKENMVHTHHGILCSYKKEQDHVLCRDMDGPGSHSPQQTNTGTENQTLSVLTYQWELNNENTWTQGEEQHTLGPVGGVRGKRKSG

SEQ ID NO: 783804 - protein, 47 aa, Homo sapiens
MASKCPTEKKNRFSMTWSITTTTTTTTSQTSPTLNFKKLEIVKLSEK

SEQ ID NO: 783805 - protein, 118 aa, Homo sapiens
FCYRYSYQDTFLPFEISMAQRFLLTASIFGFFGRAFNMFALRNMSMRMFEEDTYNSFVVSGILNIAAGVFNLIAVLQNYDAVINSQGITFLPSLQMPFKPDVQEVGTAIQVAGIGVLP

SEQ ID NO: 783806 - protein, 113 aa, Homo sapiens
VIPLQDEDKNGTDGCSALTLTQNSLPLLLQSGLHSMNYARTCARGLIEVGSLSRLKTNCFKTSPFTIKELQVWGASPRLFSMEQHFKLFCNHAQCKKPNGDQTMKAEYNMSTC

SEQ ID NO: 783807 - protein, 38 aa, Homo sapiens
MPEPALGAQDSTVCKVDGAVPFLEPRTPQFARWMVLCP

SEQ ID NO: 783808 - protein, 79 aa, Homo sapiens
PFRPKNLEMTGLLLNHDSVGNGVDTTLMKEHRWDEIQTHQNGSGSQARWLMSVIPALWEAKEAGSLEPRRSRPRPAWIT

SEQ ID NO: 783809 - protein, 79 aa, Homo sapiens; identical to SEQ ID NO: 783808

SEQ ID NO: 783810 - protein, 333 aa, Homo sapiens
LIETGFHHVGQDGLDLLTLCSARLGLPKCWDYRREPPRLADVVHISGVPEELFEVSIWPSQALVEFGQSLVVNCSTTCPDPGPSGIETFLKKTQVGKGPQWKEFLLEDVTENSILQCFFSCAGIQKDTSLGITVYQPPEQVILELQPAWVAVDEAFTVKCHVPSVAPLESLTLALLQGNQELHRKNFTSLAVASQRAEVIISVRAQKENDRCNSSCHAELDLSLQGGRLFQGSSPIRIVRIFEFSQSPHIWVSSLLEAGMAETVSCEVARVFPAKEVMFHMFLEDQELSSFLSWEGDTAWANATIRTMEAGDQELSCFASLGCNGTEDKKASA

SEQ ID NO: 783811 - protein, 135 aa, Homo sapiens
ERLHSLSYPSQRQTETADNSNTIMTSQCQTGPMSNSSISLPYILPRSPPPPPPRYNNQPPSSHRPGTVAHTCNLTLWEAKAGGSLEVRSWRPAWPTWRNPVSTKSTKISWVWWQVLVISATWEAEARELLEARRW

SEQ ID NO: 783812 - protein, 52 aa, Homo sapiens
PSYPLHKHGHLSDPQHLLPSFQCTPSNMLPFSGQGYLCNAYANVTPPLKTDV

SEQ ID NO: 783813 - protein, 124 aa, Homo sapiens
LHRCPSCCLGPFARLLPTWPPFFPTNNVAPRFLQVPSCPVKPLASCQAQEMPSDLFRAFAPQETQPRSRLRHATETQKAPTRAGPGQDYLTAAHPSPEPSAARSSGFPVSPLPPRRPCVQCFGP

SEQ ID NO: 783814 - protein, 30 aa, Homo sapiens
MEKGLSGCRDPPKKGGRVSDQKGGTENMYW

SEQ ID NO: 783815 - protein, 120 aa, Homo sapiens
DTHTHRHVLVSSVHTQEHTYTRTHIHTQMQGLHIRARTHACALVCSALSCILLLTEGAPEASPVPQESHFLLSFPSRATSHQRWAGLAWCLTCFPHLHDADDQCSHGRSPAMCLAHTGPQ

SEQ ID NO: 783816 - protein, 90 aa, Homo sapiens
LWISSPQCQPGTGKACQLQQRCQSIRPKLHSVHSPYLFRCKTQSPSFLVQEESHFKWGERKHPSTCAVDDKGISDALGSVLEILYRELEN

SEQ ID NO: 783817 - protein, 96 aa, Homo sapiens
SPQVTGTCTDGELWNSPWPRKVFAFQGPWDHLGSGCITCMCGYKEPSSLQEATVLLLGPPFSSTLPYSKLPSLYFALFKATITKYQNKGPNSATIV

SEQ ID NO: 783818 - protein, 121 aa, Homo sapiens
PAQPRAAAASGRTEVTFSPYLGNQAFLPGTVLGLKLCILQTFAAIFPLSPRHPAIKPDEYHKTVCPQQLPTPEPNDSSALKKENQACCPSPVAFRWVIRAGPCLPLGFSGLCSDTMTAARG

SEQ ID NO: 783819 - protein, 61 aa, Homo sapiens
MAQPCWSLQPLPPGFKKFSCLSLPSHWDYRCPPPHQANFCIFSGDAVSPCWPGQSRTPDVK

SEQ ID NO: 783820 - protein, 50 aa, Homo sapiens
MKDGEGWPQGARHVANSCERRRGCIVVVHLKDLEHLNPTHGETGLTGAGS

SEQ ID NO: 783821 - protein, 53 aa, Homo sapiens
LHSLAPPQAQPSTGRITGQGLGAANPPPTGVDTYSVPDRRELCLTGPYLSLSL

SEQ ID NO: 783822 - protein, 220 aa, Homo sapiens
TTSPNDKITSSAAESTEHRDRATSANVITPAPAEPIKHAKRTTLAHEKMTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVL

SEQ ID NO: 783823 - protein, 79 aa, Homo sapiens
TAGPTPGSLPIGATGQTAAQKHDGNQQGLGGSHSQPRHAPRGQAHIGQGASQLPPRGSVPRAPNAIPSKGRPWQASGSQ

SEQ ID NO: 783824 - protein, 124 aa, Homo sapiens
TTFIVWTEKREQDLCRVIQPVAVSGPQTPGQFPSCCTTPRQRKRNGPSTKHCTEGSWASPEALLCTPPSIHPSILPSLPPFLDPSISPFLYSFIHPSIHLSIHLSIRPSFLLISPFTYPSLHLS

SEQ ID NO: 783825 - protein, 53 aa, Homo sapiens
MSHILEEKCVPCRGPPGALSLRSDQGQCWHRLCHCTLVAPFFSSAFRVAQWGS

SEQ ID NO: 783826 - protein, 113 aa, Homo sapiens
GHPVTSPQTDLPCLPSVPFRPGEVSCCQDVVRPTVTSSLLFLQKHAGRGSAPGWSLSFRVCACRARKQCGEGQGILVFCCVAWHWWTWARRCRRPVPVWCLQLEGPVNGGCVQ

SEQ ID NO: 783827 - protein, 101 aa, Homo sapiens
MHRYDSWHSACYKEEKALPVNQTICEYLQLPNHINFSLSLPGESYSEQLARIRRNKAFFSCSDRALLNVYLPEEGRKRKGLLVTFSSLEEEENSDLMSLSL

SEQ ID NO: 783828 - protein, 140 aa, Homo sapiens
AGPRTIADRPARDPIACPRAMRSPDGSSAPSDPRSRPRAASGMRSAEGPGPDTRRRRHESDLMCFGRTRVVVPCGDGHMKVFSLIQTGGDPYRTAIAKDPNYWIQVHRLEHGSMAGNTRPLMTFFVMSQTHNDRLRRCMW

SEQ ID NO: 783829 - protein, 113 aa, Homo sapiens
MYSLQRAVSILSPSHKRSGGVREDQGRDPCLTPPPGLTLLPAIVPSVNLGWPSLRGLDLPLPRSPSPRVVCNNQDMCRVIFLSTPSFFIEQISAFQELGVSAIFCFLSLPLQR

SEQ ID NO: 783830 - protein, 113 aa, Homo sapiens; identical to SEQ ID NO: 783829

SEQ ID NO: 783831 - protein, 41 aa, Homo sapiens
LALPTALSGRPSVPHCLMYASSAVLLGTVDNPSETRALSAP

SEQ ID NO: 783832 - protein, 124 aa, Homo sapiens
MPVQLGQLGRGVTVPWACQLVKKEVRFGKPGWLTWCSLSISAHTSSAGPEIHSVSTSLHFLLWGISANAFPPQFWALGVRGGGCGYSLLMTLPARIIMMITITIVVIPSSEARGGVSGCRAAQQ

SEQ ID NO: 783833 - protein, 109 aa, Homo sapiens
ILDYFFSNPKSSPHNSWPLFLPSSLLLLLHYSLDPHGSTFDDHLSPLSLTPHITHFSNKMLQSPSVEDAESPLLNWVGRALPDLLTLPLQPDSLYFPMLRRHHSQACPL

SEQ ID NO: 783834 - protein, 53 aa, Homo sapiens
PPATRTSVALDRCHPAGVGWLYSMQETSSKGFFAFLVLHFSSLSLSTYCVLGV

SEQ ID NO: 783835 - protein, 52 aa, Homo sapiens
NKAHSDLSNKLCCPLAVTAAACQCGLLKASTDAELKLLHVPRSSCLCQKSPS

SEQ ID NO: 783836 - protein, 157 aa, Homo sapiens
HPCPGLPSEHPQTWACSNRRAICKPQCHQPHGLWRGLRKAGSACRRGTKRKANSWPLQPRRSPIPPPCLPFRPADTTVCKPWSSSPPLSPPPPPPAGLRRKVATQSPRLGPAWFDFLPCVSPMRWPCPWPVYSCAQAPRDPKARPLSAAAPRRAGRP

SEQ ID NO: 783837 - protein, 46 aa, Homo sapiens
HSSHENRKRQKRRQKQEWGCFPARQRLMGEMCPWKLYLALCSFLSG

SEQ ID NO: 783838 - protein, 234 aa, Homo sapiens [sequence omitted]

SEQ ID NO: 783839 - protein, 36 aa, Homo sapiens
MRERQFCSSCQENTKDDDFPGPEKGMNSTEAGNHHF

SEQ ID NO: 783840 - protein, 119 aa, Homo sapiens
VPLPFQLILFHHPLFPVSPHYSTCLEQVLHLYIHITGYQVCNKLSDAATFIHTPKCTCIHTHTHTHTKVLLNTQRQNQSPLPYTSGVLFNLHNTDLHDSICHKDHCSHIITISHSSLHS

SEQ ID NO: 783841 - protein, 76 aa, Homo sapiens
APFTQAKRWKQLRHGSTGEWISNTRSIRTMEYYSAFKRRGSLTVAAAQVNLADIRLGEISQSQKDKYRVTPLTGGP

SEQ ID NO: 783842 - protein, 45 aa, Homo sapiens
KEKMLLSVTSRPGISTFGYNRNNKKPYVSLAQQMAPPSPSNSTPN

SEQ ID NO: 783843 - protein, 196 aa, Homo sapiens
MGSRSSHAAVIPDGDSIRRETGFSQASLLRLHHRFRALDRNKKGYLSRMDLQQIGALAVNPLGDRIIESFFPDGSQRVDFPGFVRVLAHFRPVEDEDTETQDPKKPEPLNSRRNKLHYAFQLYDLDRDGKISRHEMLQVLRLMVGVQVTEEQLENIADRTVQEADEDGDGAVSFVEFTKSLEKMDVEQKMSIRILK

SEQ ID NO: 783844 - protein, 196 aa, Homo sapiens; identical to SEQ ID NO: 783843

SEQ ID NO: 783845 - protein, 218 aa, Homo sapiens
MDIDRLEKKIEDLSKTETEHQMQLHTYENTLLNKDTSLQKKGLYIEELKSTIIEYGSIIENLRGEKSKLAHELQHLQQALITNGIQLNVNGECNSIISEGEKSLHYELTLAQSAENTETERQHNVINLSSLDAMMDQEMLLLLREPAQKAVEFTATLQKLHEEISKIATLIENSRRWVTNPEITVKEKWEEQLTDSTSIMDREARSLLINAVTFWETK

SEQ ID NO: 783846 - protein, 123 aa, Homo sapiens
MINNSGKELPQYRAQQQDLKIDHRLESLGAGVWGESGVTEKMDFCQEIPKLFAIKGAAEIGTQTKCQILMYFLNQIFFRNLANLITRELINNGTIWKEQFDRESKSKHRIFLKNKGLKLDPRI

SEQ ID NO: 783847 - protein, 67 aa, Homo sapiens
STMAATNQLSSPETLTGSDLSLLSTAKSAAPSYCSESPPLAAFLPSQGLSMVFNLASSTIQDLLSST

SEQ ID NO: 783848 - protein, 68 aa, Homo sapiens
LTVSSHHLIAFSRIVSGFALRKADCPGLLPPEEGAKMSPESKRLFNIIILDGLICVSSHETQMEISCP

SEQ ID NO: 783849 - protein, 35 aa, Homo sapiens
MACVWAVMNGPGRSESWGVIIREGEVWGQRARPAA

SEQ ID NO: 783850 - protein, 118 aa, Homo sapiens
SRLGMMPLCIYLYTWSWSLQQNLTIPYQNIGITLVCLTIPVAFGVYVNYRWPKQSKIILKIGAVVGGVLLLVVAVAGVVLAKGSWNSDITLLTISFIFPLIGHVTGFLLALFTHQSWQ

SEQ ID NO: 783851 - protein, 85 aa, Homo sapiens
KLPIVNDRDELVAIITCTALKNRDYPVASKDSHEQLLGGAAVGTHEDDKYHLDLLTQVGVNVIGLDSSQGNSVYQIAMVHYIKQK

SEQ ID NO: 783852 - protein, 118 aa, Homo sapiens
SGQWSPIPALSSAVRTSGQSLGEPWILTTAPPLSPSSHSPSPTLPWNGEICIGIPPVPLPCASEVHVCSYHVGSRHIEFITFRRAAVPITPVTSMADISVCRWTTSPSPLLHHFLSSV

SEQ ID NO: 783853 - protein, 104 aa, Homo sapiens
MTHPACEEGAPQQETDQNKQHREAWTRDTNHADCARTTQGHERDLVEKRHNNPRGRTSTIRGRPHTRRKNDRPSSKDTTDDATTGNNNQMRGGDKHRNEETETI

SEQ ID NO: 783854 - protein, 133 aa, Homo sapiens
MSSLVKSPLTGGLQPPNPPNLHRIPAPFRFSHPVVWACHILEATGTLEGEACVGLTARDRPLWVSVNQPGIYLSGWHLEPVQGPHLTEEPPGSEVIVQVYALGVDTIAIQGIPQVVELGQRCTSDRVPKAPDT

SEQ ID NO: 783855 - protein, 152 aa, Homo sapiens
MVACFLQIISFYYVFFFYSTQIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQR

SEQ ID NO: 783856 - protein, 166 aa, Homo sapiens
MGTGDFICISMTGGAPWGFRLQGGKEQKQPLQVAKIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQR

SEQ ID NO: 783857 - protein, 117 aa, Homo sapiens
RIQRPLNSRSPNHSLFVKAELTAKQATMKLSVCLLLVTLALCCYQANAEFCPALVSELLDFFFISEPLFKLSLAKFDAPPEAVAAKLGVKRCTDQMSLQKRSLIAEVLVKILKKCSV

SEQ ID NO: 783858 - protein, 144 aa, Homo sapiens
GADRHCLSYAQAYPIAVDAGGIAEGTVTAWACPTRLTHTLAHGAASSVCREGQGREMRATSVPVVQAAHLAGRACGSRAVGARMPLAWGRSHLFLTFLESPSLHLCLHPTYLPLCSLSNYLKTNPIMWLLLPWLRTSNGSLPMQ

SEQ ID NO: 783859 - protein, 60 aa, Homo sapiens
MCSAGSCSESRSSSDTLNLRSSATTFCLKFCCLVMDVVLTIDLRCFFGFPTSKSSSSKSE

SEQ ID NO: 783860 - protein, 138 aa, Homo sapiens
LGPTPKRGCRGPVGFQRRIHGSRCHVSNRRFKVSCYHGYRNASLFLRVRMDTHMCIRAHMHPQALTEPWVPTAGRPGREHHSALRPPQRLLGCALLLRRRPAPEAALAGVTQPGLQLVGRPAGMAGHPQRPAGGCARR

SEQ ID NO: 783861 - protein, 49 aa, Homo sapiens
SLCSCCHIAFHLCLLCPSCKATCDYKSYLDDPGFSSCFEILNQFFKILL

SEQ ID NO: 783862 - protein, 104 aa, Homo sapiens
DHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRR

SEQ ID NO: 783863 - protein, 210 aa, Homo sapiens
MAVVIRLLGLPFIAGPVDIRHFFTGLTIPDGGVHIIGGEIGEAFIIFATDEDARRAISRSGGFIKDSSVELFLSSKAEMQKTIEMKRTDRVGRGRPGSGTSGVDSLSNFIESVKEEASNSGYGSSINQDAGFHTNGTGHGNLRPRKTRPLKAENPYLFLRGLPYLVNEDDVRVFFSGLCVDGVIFLKHHDGRNNGDAIVKFASCVDASGG

SEQ ID NO: 783864 - protein, 45 aa, Homo sapiens
ELRRPAQLRLQVYRLLSTAGTPENGSEPESRSPDNRTQLAPACMP

SEQ ID NO: 783865 - protein, 137 aa, Homo sapiens
LWSLPDRKRKLLRNLKQGQGCDEIGMAMRKLDVGVAGTCRLHYDLGRMEGQQRGMRWADIWQVVSSMDNHSYSPPQSLLAPCLSPSPTIENNMLCCHLKPPFHGRARWLTPGILAFWEAEAGGSLEVRSLRPAWPTW

SEQ ID NO: 783866 - protein, 133 aa, Homo sapiens
FLDLAFPRSLSFLLPRLLLGNVKAEKTNCRNSYPAARPPFHQSFFGVNGAAASLLLHCQRPRARGAGWELLLRARDPLFLPLQRLGCVKASEGVIPGREKRRRRVTGKPFPWARGAQGARLCRPGLPSERRRA

SEQ ID NO: 783867 - protein, 92 aa, Homo sapiens
GDMIRIELVPLVLEVSIAGALLGRLGHQRLFPLGLTRAVNVSGHLNTALHIRCPVCNGAGFCKHKLPWRNRIIIAHQALWQQCCNQCKHLFI

SEQ ID NO: 783868 - protein, 67 aa, Homo sapiens
MVSTAREAAEQTDATCRRVASLKFGNVQISIYTRRQQQMPAEKALALSHTHGQQVANRALHVMAASQ

SEQ ID NO: 783869 - protein, 111 aa, Homo sapiens
ITDVSTPLVVSWLWGHQGISMVGQSGDIHSWKPQSAPTPPSRPPCDHVVSRLHFLNSRQPPSTPLNLIFSRGFSTIWHSTDSTCQRPADFLPRSTGGAKYALTFPKMTCLM

SEQ ID NO: 783870 - protein, 43 aa, Homo sapiens
AASGLERGRGQRKSWFWCIFAGKVVEPADRLEAEDEEEREGKG

SEQ ID NO: 783871 - protein, 123 aa, Homo sapiens
QAGQAPPPISSSPLLHHSLCPSAPGGLFRGLTRPAGAATVSPVPGAGVLCSQGVLRLLLKCGSCWVTRASHLCGIRFQSGLRSRGRWAQLQNCLEPSPASGYVCQSPPGGGQGQVPILVLRGL

SEQ ID NO: 783872 - protein, 107 aa, Homo sapiens
PTSQDNVLLAPQSLKPELVGAGRQPPASICSGGGGVQGGAAGFPLACKQEHRVFLSGCENADENPRMLCHRGGQLIVPIIPLCPEHSCRGRRLQNLLSGPWPKQPME

SEQ ID NO: 783873 - protein, 49 aa, Homo sapiens
ILNLQRTESPHATIPVLNSSLGPENFRYPHFRDFLSTKSNSFIQDKRLF

SEQ ID NO: 783874 - protein, 154 aa, Homo sapiens
WWRLTELGEDGVSVTQAGVQWRNLGSLQLLPPGFKQFSRLSLASSWDYRHTPPCLASFCIFVETGFRCVGQAGLELLTSGDLPTSASQSAGIPGVSHCSWPVFFMETEKPILKFTENLSLSLCHSLSFYKTWCHYVAQAGLELLGSNNHLTSAY

SEQ ID NO: 783875 - protein, 178 aa, Homo sapiens
KPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQ

SEQ ID NO: 783876 - protein, 66 aa, Homo sapiens
EDLPARRLPSSSLPISVWMPSSRSFEEVIVIAVRGVIHQVVGEHTPEEPHGLQPRLDGQQGDAEQL

SEQ ID NO: 783877 - protein, 42 aa, Homo sapiens
MSFEDKTRDFKETPSLQRATGGCIPRRQESWDSEEESGNYGM

SEQ ID NO: 783878 - protein, 63 aa, Homo sapiens
PGMKHPQMGNWPEQVHSLSPTYFSPLTVTGSLRCGPGEVRNVRQSQLLTAKGAGIRVHLPEVP

SEQ ID NO: 783879 - protein, 43 aa, Homo sapiens
QTGTSAPRPSNWNMSSPRCLQLHGPETGTSAPSWVSSCMDLKL

SEQ ID NO: 783880 - protein, 76 aa, Homo sapiens
AHGGLRKKSQADVSGIKLEKAVDDGPGLPSSLSLFMGFLFISQKHSDSWIYSKKSSRVSDTVFLSGSGSIKLPGRQ

SEQ ID NO: 783881 - protein, 44 aa, Homo sapiens
ADVLLVMVLVIEVLLAMDVFMVMVSAVEALMVRNVFIITVLVVE

SEQ ID NO: 783882 - protein, 68 aa, Homo sapiens
MRATSLLSTNAPVPSPGHNVVQTLLALTCLWFHGITKNILTSFLLSMGWRQRPEQPPVGHPPRLLRPP

SEQ ID NO: 783883 - protein, 41 aa, Homo sapiens
MALEEDGSAHGVLLLNSNAMDVTLQPTPALTYRTTGGILDF

SEQ ID NO: 783884 - protein, 111 aa, Homo sapiens
EEAFLVGCILLVGLLYSRSKTRFRQNIQASVAGQKVSSQNSRSPRISEQDLVWKQGLCRLSETDSYGLNSEEIAGGRHWQDMRPTSCFFTNRPSFFQHGHKSSTNNGSRLV

SEQ ID NO: 783885 - protein, 70 aa, Homo sapiens
KRPNTSQETTVDQSWEADQTRWRRTTTPTFSISNYIDLTPHLLTCRLTKHLLGYGLLSPVQPPPFPGCVL

SEQ ID NO: 783886 - protein, 124 aa, Homo sapiens [sequence omitted]

SEQ ID NO: 783887 - protein, 126 aa, Homo sapiens
EATAAMEKAGLAPGGTEALERPRGSLARSGWSCALLPGSGPVTWGTGPAKTGPLGASQHLGQAPGGRALADQPRTPNSPTGGPIQGHTSCPQEQDIPEARVQLDRWKGLTLCPLTPLVGTLSASDP

SEQ ID NO: 783888 - protein, 104 aa, Homo sapiens
MRSTHKENGLQHHKLHIHQTGQGLGIESLSGKKTPATLCTLGNIKNQNKTCHINQNINQFSNQSKVPPHQGRPRSGLWRGGPGSRRNPNHAGSQEPEKRQSSPA

SEQ ID NO: 783889 - protein, 176 aa, Homo sapiens
SVYRSIFSSQCLCVLPGVAEEHTSRNAQIEIHIPQKISGRGLHGSPAPTWLEKFSQTVTPVIIMRKTSDQSQCRRILQLRDQQASKLSRVTCLETVKGHQIKTKVSLRNYPAQRLGGASRRPKTDATWGPGIGLIAQSQEASKKKGDLNCTQQVCLHLCPEFNLSTICSCRGTWEM

SEQ ID NO: 783890 - protein, 110 aa, Homo sapiens
PAFSMAPFTTLLGALWPENLCVSCLFLFFETESCSVTQAGECSGVISALCNLRLLGSSDSLASASKVAEITGTCHHAWLIFVFLVETGFCQVGQAALELLTSNDPPTSTS

SEQ ID NO: 783891 - protein, 121 aa, Homo sapiens
KRPLPCAPIHNNTESSGTLALGTNATELQELQTAGAHKTWASDCVLTPGPLSSGKHFTGDMSCAQCLLNTHGRAASLCIHFCVSCIRRPFHKKCGHVSVSLSTVPSMVLGSVQVFNKVFFE

SEQ ID NO: 783892 - protein, 164 aa, Homo sapiens
SALRTARPGSTASTDNAGSDGFKCMPPFRVCCPGREVRGETRQRGRQQPARRRTRCVRAGSGPSGVGGAIASARLGCCSPGPGNRGTCDPGMERPSGLGDPWDRQLWGRVTSRTVRPPRPCTARAPAGEGRLGGEGAGGAGQSGPRAASPSGVTAASPRGPTRR

SEQ ID NO: 783893 - protein, 118 aa, Homo sapiens [sequence omitted]

SEQ ID NO: 783894 - protein, 103 aa, Homo sapiens
RGNFPPKERGVVPTQKGGAELKDREASAFLHMEVIIPLPASPGHSEDLAALEEASPSPTSHGSGEPSELREPFLRHVHLSKASPEPKDQVGFVVSPATGGERR

SEQ ID NO: 783895 - protein, 103 aa, Homo sapiens
HTTKQMGAFQLRIADKPSIIIDKLKNIGSHYCLGRHLPCISLHPWLPSACSSDSPPDSSSCLLIPSPINSSERLLIDTMLFLIYHENQTFHLHNCTINPHYNL

SEQ ID NO: 783896 - protein, 68 aa, Homo sapiens
RLCKDVLEFRKGGEDPLQIFILEQEDPCPTGTLQAPSCPALSLAAWTSQRENNTRAAAADTGSRSCWV

SEQ ID NO: 783897 - protein, 36 aa, Homo sapiens
PSLIVQTHLLQGPRHRRLRSVHCLQLWVELTAGLED

SEQ ID NO: 783898 - protein, 119 aa, Homo sapiens
LPPVCSEHVLRPRGASFLNPRMGATVPGLPHPGSSPYFSMQSDPGTQGRSVRSDPVMQGCSVRSDPVMQGCGVRSDPVMQGCGVRSDPVMQGCGVRSDPGMQGCGVRSDPVRWSLNMPC

SEQ ID NO: 783899 - protein, 121 aa, Homo sapiens
HRRDCVFEIISGPVLCLSLHPCPLPPEPAASSTSGLAGLPHPCPLSLAVSVAPASGLLGKEWCVSSDLGLKRPACFFWLSCHCHKTMSAYPSSWRTMKDTRNRAAPAKAGLEKATQANLQM

SEQ ID NO: 783900 - protein, 101 aa, Homo sapiens
PGWVLGCAPALVPPRGLGIRGPQAAASVPLALWVSPGPAHQPSGLVLGPPCSPGSVLGPPCPLGQPWVSPLCPPFLGEGSAPLDLGGNRKVWLEQMTFSKP

SEQ ID NO: 783901 - protein, 133 aa, Homo sapiens
VRPTTAAVTTHIQRWHAGIPRGDALGRPRHATCAREGRQTETERAGSGFRAQHPDYQKHDTPAVTTWPCLYNTETPTPPSDTRAPLPEGHGTHGHVDTHAPHTHTHTHERTRAHTGRQGEGKEPETAGEVKSG

SEQ ID NO: 783902 - protein, 136 aa, Homo sapiens
IGVARGAGRQGREEDIFFSAYPLRPLKFCGVYTLYPCKIIGIWIFTDCLLCARYHDMHYKHKDELKILYVLQWFKTKSLEFSFQSTFILDDLQSYKWMTFMFTSVAQTSSLNCRLRKSNCLLDNSTWLSMTASQTG

SEQ ID NO: 783903 - protein, 95 aa, Homo sapiens
WVSGWESRWVSGWESGWESGWESAGESGGESGGEWLREWMVEQKGERMGERMGEQMGERMGERMGERMGERMGERMGERMDERMGERMGERMQEW

SEQ ID NO: 783904 - protein, 113 aa, Homo sapiens
PTIYLLLPVYLLPISNLSIWKDGTSLQKAVLGFQSQKELKSYHLLEATLLLKLSPIHTPQCLIQQSPREPPDFHRRHATSATLTPPAIDSHTLWTNICPVCPQCTSWSCPFSS

SEQ ID NO: 783905 - protein, 142 aa, Homo sapiens
SGRSGAVLGRGQGRGRGRCWGRRWDLAPGSPPSLPTCGSRASSVSLIECGPVDTAFMQKVLGGPDQVMDRTNTRTFRLLHYYLHHSKEIYREEAQHPEEVVKVFLTAMRAPKPTLRYFTTRRFLHQLLMRLDDPFGFDYAAA

SEQ ID NO: 783906 - protein, 128 aa, Homo sapiens
QAGTPPEWDIVDRACNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 783907 - protein, 281 aa, Homo sapiens
AWAEREAEAPRRPGRPGRPGCERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYQGLVRVRTSETRAQAPQRGNSQHRSSWLLPCRNVGLVLPDLLIFRKKLECWILK

SEQ ID NO: 783908 - protein, 213 aa, Homo sapiens
AWAEREAEAPRRPGRPGRPGCERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHQGLVRVRTSETRAQAPQRGNSQHRSSWLLPCRNVGLVLPDLLIFRKKLECWILK

SEQ ID NO: 783909 - protein, 360 aa, Homo sapiens
AWAEREAEAPRRPGRPGRPGCERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 783910 - protein, 167 aa, Homo sapiens
MHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 783911 - protein, 366 aa, Homo sapiens
AWAEREAEAPRRPGRPGRPGCERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFSLAHLHRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 783912 - protein, 265 aa, Homo sapiens
TGLCGDCRSLSRCPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 783913 - protein, 227 aa, Homo sapiens
AWAEREAEAPRRPGRPGRPGCERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHQGPALTGCGVARTKTASYAIAATRPPRQAWAGPGHVGCLGRCLPCTVIRERLGCVLSGTPPAFLLTLL

SEQ ID NO: 783914 - protein, 171 aa, Homo sapiens
AWAEREAEAPRRPGRPGRPGCERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFR

SEQ ID NO: 783915 - protein, 73 aa, Homo sapiens
AWAEREAEAPRRPGRPGRPGCERLPHAPPPLRTMFPSRRKAAQLPWEDGRSGLLSGGLPRKCSVFHLFGPGEG

SEQ ID NO: 783916 - protein, 97 aa, Homo sapiens
KDGKVNIDDLVKVIELVDKEDVHISTSQVAEIVATLEKEEKVEEKEKAKEKAEKEVAEVKSSEPLAWAPVLLLCRHPGKGREGDCFVVILSGSSNIL

SEQ ID NO: 783917 - protein, 44 aa, Homo sapiens
STLGRSQPYECNQCGRAFSQLAPLIQHQRIHTGEKPYECNQCGR

SEQ ID NO: 783918 - protein, 176 aa, Homo sapiens
LHRRSHPAAPCHSVPAPAWSLQQGPEDAARLPSAARWREGRLGAAQPASPLRKSSGSLLLAKANTALFFPDRANAPGTRAATHRAPAECSVSSGKAPGVQSRPWANSQDCSSRRERAEARRVPAWPQRPRRPLRHPRAAERTGSREIPCPHSWQRTLWGGRAAGSRRLPAEAATAA

SEQ ID NO: 783919 - protein, 107 aa, Homo sapiens
VAGSGRMSSKREPLLGLEAQAVLSKCKSRAEAGCLEVSSLSWVQFSAMSSRLLPAGLGWTGPHAHLTPHTGPQLRVLHKGRRCYPQQGWTANMIHLGSHVNRLVQDT

SEQ ID NO: 783920 - protein, 74 aa, Homo sapiens
PPPGSICVPVHTRQQPYVLSEEETPKDKHWLPEHQNWRDPLRGAGVWAQPHKTLIICPKTKRSSDRTRTRSLSL

SEQ ID NO: 783921 - protein, 134 aa, Homo sapiens
MTPLPYRSRVKPRSPTNTHAHLELTLVKCSKKDVGWSLGIIPWSSGYPRPLSSHSSPEHIPLEKLCTCAQAPAAGVPSTAQLFMKNRNQPKHLYEEKRRNAEWHVHMMEYYAAENMNNWSHGMNEAERFEASTK

SEQ ID NO: 783922 - protein, 57 aa, Homo sapiens
QLGTPLQTQIKPILFAHALCFRHLSWLTMPALFTLSPGLYMPSSQPSVLCPHLLVKW

SEQ ID NO: 783923 - protein, 113 aa, Homo sapiens
MDASDPTPSPCATIVNIHMEAISPAPSSPQPHLTSMHPATLLLLLVRANEHRSHCHRPTKDFGWHHPLECCGQWSGNTLAPPVQQVHNLVGPENKAEGPIPNPSELEHTAQEG

SEQ ID NO: 783924 - protein, 102 aa, Homo sapiens
MTLVTSLSLMSQVSTGRMCRSFLNRPHEPNGLKNGYHSVNYAWEPPGSPGGWAVYEYPSIPFVHCGQSRPNKMRPLCEWALKAAYDKICSSPSSLPKKNFIL

SEQ ID NO: 783925 - protein, 206 aa, Homo sapiens
LRVRSSGGTEFFTRSATKFKGALAQKFMFVDGDRAVCGSYSFTWSAARTDRNVISVLSGQVVEMFDRQFQELYLMSHSVSLKGIPMEKEPEPEPIVLPSVVPLVPAGTVAKKLVNPKYALVKAKSVDEIAKISSEKQEAKKPLGLKGPALAEHPGELPELLPPIHPGLLHLERANMFEYLPTWVEPDPEPGSDILGYINIIDPNIW

SEQ ID NO: 783926 - protein, 106 aa, Homo sapiens
TKTTPTRPISKIGNHISTCDLEGTNIQTISPGNVICFESTWIDINVATPFSFDGCYGTSFHPLTFFFFFFWQGLPILQNWGSLFSTCVIFIGGTGGDSSRVRPCEA

SEQ ID NO: 783927 - protein, 128 aa, Homo sapiens
CVDVGTSMQLCVTTHLCVSLYTPAYLSIQAWPTGLPEHASLSKHTLSTQGPRHTCGSASSPCSVCGHCSQGPALGSVEMGRLRLERASSPQGSLRGYGWPWATRGYGVVEGHGPADEAALVRGHGAEP

SEQ ID NO: 783928 - protein, 114 aa, Homo sapiens
EDQTMCFFFNSGMNCRWSKGKKNQKKHKRFKSRIIALTDPNANASSYLHPLVMPSHTNTGLGHVAFLLFFKWDSNNLTQSNLITTLKKFVSFLFLLSRPTENPPSGHRCMEKTH

SEQ ID NO: 783929 - protein, 108 aa, Homo sapiens
KDPSHWSHRGYSWNWKLDAKLSLENKVSLSSGMEVSTGSKAGSKKNLAWKRGLELPDKMVHSTPMGLRDFLVAWGQESSIFVLCSFSVSILISDHISFPPRPQFLTLR

SEQ ID NO: 783930 - protein, 104 aa, Homo sapiens
MTISHILIVLIYQHALEFPSKKITRVRAFVPRLNMPCDYTVTATDNSHLLVVNVLVSNSSVCLQNRWALLSDKTKPMQLRQYSNRVKALNLVPMFLLQKNLPLA

SEQ ID NO: 783931 - protein, 158 aa, Homo sapiens
GVGVPPPATGGGDGPFACPLCWKVFKKPSHLHQHQIIHTGEKPFSCSVCSKSFNRRESLKRHVKTHSADLLRLPCGICGKAFRDASYLLKHQAAHAGAGAGGPRPVYPCDLCGKSYSAPQSLLRHKAAHAPPAAAAEAPKDGAASAPQPPPTFPPGPY

SEQ ID NO: 783932 - protein, 71 aa, Homo sapiens
HPNVPWVKHTHILKASSFFYEMGTILLPAAWVPQRELHSLCHNLGNRKTLEPHQKNGSLTCDPLSPTRISS

SEQ ID NO: 783933 - protein, 101 aa, Homo sapiens
RSSLQQSNPIQTTSSPERTDPSSSPSLSSQKWPWSRKEGTPLLLTTSKTCSIPPDHHLELLFRDSTSASVSGVNLPAEMLRPGHSLHCLFSPTVALGLYTT

SEQ ID NO: 783934 - protein, 178 aa, Homo sapiens
HANNSHGTVQAAANIIVQAPPQFTVTPKDQVVLEEHAVEWLCEADGNPPPVIVWTKTGGQLPVEGQHTVLSSGTLRIDRAAQHDQGQYECQAVSSLGVKKVSVQLTVKPKALAVFTQLPQDTSVEVGKNINISCHAQGEPQPIITWNKEGVQITESGKFHVDDEGTLTIYDAGFPDQG

SEQ ID NO: 783935 - protein, 74 aa, Homo sapiens
CVCICLHVHLCVHISVYTDACLHASACVCTWHICGSAPAVNTVGPQRAAAVTVITTTPGSSILIAAHLAVSMGP

SEQ ID NO: 783936 - protein, 72 aa, Homo sapiens
RLKGVGFGLDGADLSLHLQEEVETEVAWEECGHVLLSLCYSSQQGGLLVGVLRCAHLAPMDANGYSDPFVRL

SEQ ID NO: 783937 - protein, 91 aa, Homo sapiens
LGVLELERPTQALEKRAGAFLGCSWPCLGAEVRKTVNAGSSVSEIRLPSKKAAILEEKAPGRALGIGEREKGTGQPTPLASQTAGLGDTWR

SEQ ID NO: 783938 - protein, 91 aa, Homo sapiens
SPSPSIATAASGLTYVLKRMPLPWHKQRVRCMWWTGGLRSVCQPSCWDLDPDVNSRGSAPSTSAFQRPSLEWTRIVIYDFDYPALRNYLGL

SEQ ID NO: 783939 - protein, 128 aa, Homo sapiens
PGLMPTENWDPAQSAGLVAEMMWGAGQSTWMQRGRAARWACPQDNSFLGIRAPGTAHQPREACQLQKRASGVLGDWLPGLGQELGTCTDKGRRNSSQEGVQIHTGMYFVRKVGFHSCKQKTGALDRWG

SEQ ID NO: 783940 - protein, 113 aa, Homo sapiens
WEQACLVQKPEGLGANLITPSLDYGKMKTESGEMKGKTREEILSGVPKHGPGYGHTWGWGDPLACWPLLGSWYWLPGYPRGSSCSSGLMGVQAASWCVQHGLGTPGCFGKVFS

SEQ ID NO: 783941 - protein, 87 aa, Homo sapiens
LQACTPAQAPCCRQEARRALHSGQKAPPLGNFAPKTQGPSGHKHLNYETEKQASALSEDAGKTKTAEKESETPQVTAQMRTGSVLLF

SEQ ID NO: 783942 - protein, 86 aa, Homo sapiens
MGEWMDGCMDAWRNGWMDGCMHGEMDGWVHGGMDGGMHGRMGRWMDGWMEESMEGVMDRWIDGWMDGWMDGRVDGWVNGWMDEWMD

SEQ ID NO: 783943 - protein, 69 aa, Homo sapiens
LLAVEVRPGRQELLEVTETWLQPTASGTAGHCPGGRTRCPGTGAWRGSGQSGVRLSVFPGWHVGRKRLG

SEQ ID NO: 783944 - protein, 109 aa, Homo sapiens
MNGTLAGMATVSPLPSVSGAPDLPVYEEAAKYDDIKKVVKQASEVPLKGILGYTEHQVVSSDCSLAVPGITGAWYHASLNFRRGTGFHHVGRAGLELLTSGDPPALASQ

SEQ ID NO: 783945 - protein, 114 aa, Homo sapiens
FSSIPLPVNHSVNLSPASNPRSVSLTLCSRWSTGLAASYLQFSLAPLSSPWQPRAYPLVPGCFVHILPSADKNAGGIDNTDNVIWSLQLLTCGSEMVSDLSLEPGAATSGCSRC

SEQ ID NO: 783946 - protein, 238 aa, Homo sapiens
CKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYRISVCKVLITSQGYEQNMQSPFNCNLNIGVEQNSECVHRDGKSNYPVVIQEQELQELLSQSSTRFMQFNS

SEQ ID NO: 783947 - protein, 40 aa, Homo sapiens
LYSFPQQLNHCYKIANSAQVFQSPRILGYTGYFAFLIVAI

SEQ ID NO: 783948 - protein, 100 aa, Homo sapiens
TKIDTANHWWGVWGGDSNFPCSPGVHRDRKINKCDTVSYVLLEMNIQLVRWKLRRERGKFLVREGGRLRDIPWKTNGSAECRWVVEQTTKLIGIGVGVQG

SEQ ID NO: 783949 - protein, 101 aa, Homo sapiens
IHPPQTLTCTDDQKPNHLCELPASCTHTFHPYTLTDSYTPSGHICTTLMYKHTLFVVLTCLPHCGIHTQTPVANLHTEQCFHTDTCIYLLTHVCIPTNISL

SEQ ID NO: 783950 - protein, 112 aa, Homo sapiens
PSLKVVLARCGGSHLQSQHLGRPRWMDHLRSGVQDQPDQHGETPSPLNTKRTQVVCHHLERGVVLWMAPDGLYAKRLCQSRIYWDGPLALCNDRPNKLERDQTCKLFDTQQF

SEQ ID NO: 783951 - protein, 298 aa, Homo sapiens
MLPLLDSSKRAGTLGSGCGVPRVHSAALSREEGASRDIWRIKVWARVMTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPRSSDAGGTQASPLNSGTPAPIMCP

SEQ ID NO: 783952 - protein, 323 aa, Homo sapiens
MLPLLDSSKRAGTLGSGCGVPRVHSAALSREEGASRDIWRIKVWARVMTTPAGSGSGFGSVSWWGLSPALDLQAESPPVDPDSQADTVHSNPELDVLLLGSVDGRHLLRTLSRAKFWPRRRFNVSWDEDEAQIPESLREEGIEILKPQFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPRSSDAGGTQASPLNSGTPAPIMCP

SEQ ID NO: 783953 - protein, 123 aa, Homo sapiens
MNVEHERYLQANNKEFNSIFGYPKRHQSDDRVNNQPVLLLVNGKIKEDKWMNVQVGDIIKLENNQPVMADILLLSSSEPYSLTYIETADLDGETNLKVKQAISVTSDMEDRLELLSTFNGELG

SEQ ID NO: 783954 - protein, 33 aa, Homo sapiens
CWDYRREIISDLSRILADDLGRLISAWRVWRVQ

SEQ ID NO: 783955 - protein, 75 aa, Homo sapiens
GSGGRVTTWEVMAAVQAEAASFPKSGGNEIGLLIQYGEPGDRSQRQKVEGEMGGEEIEKICFDHEFEKLDCEGRR

SEQ ID NO: 783956 - protein, 79 aa, Homo sapiens
SSYMTGMSTTSSYMSGEGYQSLQSMMKTEGPSYGALPPAYGPPAHLPYHPHVYPPNPPPPPVPPPPASFPPPAIPPPTP

SEQ ID NO: 783957 - protein, 164 aa, Homo sapiens
MVNPTVFLDIAVHGEPLGGIPFELFADKIPKTPENFHALSTGEKGFGYKGSCFHRIIPGVMCQRGDFTSHNGTGGKSIQGEKFDDKNFILKHAGPGILSMANTGPNTNSFQCFICTAKAEWLDGKHVVFGKVKEGINIVEAMERFGSRNGKTSKKITISDCGKL

SEQ ID NO: 783958 - protein, 101 aa, Homo sapiens
MGLPCSSVGLWISGPWRWGRPSRTQALGVWGLRDVGGELGGWATAEAGPMAGDLGECQQGHRAHLGPGRERPLLRTMTCPPDEWRGARLAVCAGWTRGLPH

SEQ ID NO: 783959 - protein, 30 aa, Homo sapiens
MHAQAFSYLHPMGALQPHKGEEPVTVQAPQ

SEQ ID NO: 783960 - protein, 63 aa, Homo sapiens
AKGKECSEWVSKVIHKTYFRGEAKQISNPESPAAKDKNSSKAHHFSLECWLTVSLGSGAEMDF

SEQ ID NO: 783961 - protein, 87 aa, Homo sapiens
SCSRGYTNAAHIPEDDKMPREVSGSWVRIEDDVVVTQDSPLILSADCPKEMNDIDTDMQPGFLTFTAAHMHLRFKMGVFWQPCTCAF

SEQ ID NO: 783962 - protein, 124 aa, Homo sapiens
MKVSDHELKLQAVRAWCRERQPGMMLTCTLYSNVYKVLFQSNQLSHTLYLGLWYSEGSQGLEAGTALPRDTDVCVLLPLICFILPPLGFSCPHYHGSAHRAQGGRETVFGVVLYGFRKYVVGYR

SEQ ID NO: 783963 - protein, 148 aa, Homo sapiens
LGWFGAFLWVVAHRTLLDLGHGHIAAHPTCGHICPRGCFSGLEYKYKAAWLAQVCAHQEQPAGLFHAWYVGAQLPGQPRECPQGVADGAVQVQDMGCWLLGCSGGMPTRAVLWDSFSCSFRGRRTIRQARDISVVGGGTLEPVLRSCA

SEQ ID NO: 783964 - protein, 137 aa, Homo sapiens
DGSCWSMDAYMSTDIPDEGDVHNGTYCAPNKVCLNSACTDKTPVISACNPEKTCNGKGVCNDLGHCHCNEGHAPPDCVTAGSGGSVDSGPPGKLGGTPSGEGENHNMTHSRREEHAVDMMILSFIILFIILLLSTII

SEQ ID NO: 783965 - protein, 109 aa, Homo sapiens
RHEDFCEILRCFEITQAKERYPGQAGGYCNLQPFSWKSEILPYFLSWMGGALSRLSYSFEIVFSQGLSQQWLWRTELFFWLISRPFEGWCLHTPSTGSLNAKVEVELRS

SEQ ID NO: 783966 - protein, 78 aa, Homo sapiens
ELSHEIMLGANWMLLCAHLVDDFLVSGSWGTSALPLRIIELSCTIKGEEEHACPVQRTLHSAHCSIWCLPLSGGWVLC

SEQ ID NO: 783967 - protein, 101 aa, Homo sapiens
FTPLSTLSALYISAVICVPPDYRGAPRAPTLRAKVVFFISQSANVHYIIVYCESVHFLPILLPTLSTKPLSSPELNAAASYVPFPPIIHIDTAASMVGFLL

SEQ ID NO: 783968 - protein, 88 aa, Homo sapiens
TITHPQAQAHARTGARGNMQHPLLPPATPASCILMLLSFSVPPPPLPCLLQRHLSQEEFYQVFGMTISEFDRLALWKRNELKKQARLF

SEQ ID NO: 783969 - protein, 83 aa, Homo sapiens
KQHADMHTHRATRGHAHTHRATRGHAHTHSNTWTCTHTQQHADMHTQTQSNTQTCTHTQSMHRCACISLLLSTSSPICHICFC

SEQ ID NO: 783970 - protein, 104 aa, Homo sapiens
RDLMGHLVYGFQAFDGNSMRSRFDSFSSCTDTPDGMKPHSLWLPSVHALHPGESQSTLVCSIFIKILIHNLCWVSLQFKKHSCIPTSFPDETTDSLVPGATPHL

SEQ ID NO: 783971 - protein, 101 aa, Homo sapiens
LSVGTSGCKCLAAFKASSVSTILGFLINFFFLFLLLSVKSVCSKLVPVGLSASSLLVSFIPSMTTRLTSIKHQPLLSSWAMFNNTPLPLEGIWRLRALSLA

SEQ ID NO: 783972 - protein, 87 aa, Homo sapiens
SVKRGMTSTTSTVGDHKKNQPSPTTQKSQQALQLPRNQKQKGMQYGMTDCESESHRSGFKSRYPLPAVCGLNMATNLLPLFPSRGGV

SEQ ID NO: 783973 - protein, 118 aa, Homo sapiens
LESTNLSEVYSSLSNLLGGKYSNESKHRASPEPHDQRCTQYAPRVQKRPAVKSLRHVPVHLLGDHAEVRPAWFYKLASDGSVPCLLSGSAQLPFPGDMLAGCMALHLLAGARRPGMGP

SEQ ID NO: 783974 - protein, 119 aa, Homo sapiens
SAGQAVTPVGTMLVAAVRISLRFISVSSPCWFSLPASTSEMSLKSPTCLPGHHPRLTLASPNLFPSHISLSWGREGRPGERVHETVNEADVATSGETKLTAEGGGARLTLGCSTWGRGL

SEQ ID NO: 783975 - protein, 139 aa, Homo sapiens
EQNMKVGSSWRGVFVVPSAGSTPGAHPSHVPRAMRNRPLFLPNLSDSSWAAATRSSPEATWQASVIICCRRRGLESLSIEPPRGANALGTREVHRQLHNSAPRERAAPGVSLFTQGLFSYVLYQTQGTPPCLGALNATR

SEQ ID NO: 783976 - protein, 162 aa, Homo sapiens
PSVTLLFTISLSPRVRGPEPTHPQPAFTQLTPSAPSQGAAVSLPSAVTLSQSQSHVLTLGPAPPSGHAGSCITQPPGFEAPSSPPLALSLLSALPFGMSACFSQRSTLRESHLLSLHRLSSWTWTGWNRGGRTSQVVFTDHCRHPPTAAYHPAAWHSGRDTA

SEQ ID NO: 783977 - protein, 77 aa, Homo sapiens
PGLQALSPVPQEAMKTSSGSGLKVKASVFLLLSAFLFAVSFWLLSKKVSVISSIFRCFQQKSHYGIKTITFADTSPS

SEQ ID NO: 783978 - protein, 49 aa, Homo sapiens
CPGPPAYRKSGSLGDWEEVWGPGRVLVCPEGSKKKGEGEWVHLQVANTL

SEQ ID NO: 783979 - protein, 113 aa, Homo sapiens [sequence omitted]

SEQ ID NO: 783980 - protein, 93 aa, Homo sapiens
RISGALYPGDEADQQLREVDEKIRKADIDGDGQVNVMNEFVQSDDCKAEGPPGQLGDALFSMISSLLDARTSRLQRLPGDTACILGSHPRECP

SEQ ID NO: 783981 - protein, 132 aa, Homo sapiens
MLSMLLQAVFCCRRRLYLVSSILFCCFRNRDEGGKLVEGLNLLLLLSAHGLDVGVHLQLKGAQQALVDHDGCDASYNHQLAIASTQTHAGTQDTLDTAAAAHLGEARGTDAGTRPTHVGVAAEGPGPEVDTL

SEQ ID NO: 783982 - protein, 428 aa, Homo sapiens [sequence omitted]

SEQ ID NO: 783983 - protein, 410 aa, Homo sapiens
MSARAAETHRSARPAAASKPLRFPGTTMNNLLCCALVFLDISIKWTTQETFPPKYLHYDEETSHQLLCDKCPPGTYHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 783984 - protein, 233 aa, Homo sapiens
RKTGTLGSLEEPAGGASVSAGSRAVGVAGVAGEAGPPPEREGSGSTKPGTPGNSPSSQRLPSKSSLDPAVNPVPKPKRTFEYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQVTQP

SEQ ID NO: 783985 - protein, 224 aa, Homo sapiens
MRVFPRSIAKEKSHQLADFNLGVISEDCLSVLEQKRTFRLLCSRNLSLNFPQLRAQRNYPEQLRGESDKITFYEADKNPKSKPSNGLPPSPTPAAPPPLPSTPAPPVTRRPKKDMRGHRKSQSRKSFEFEDASSLQSLYPSSPTENGTENQPKFGSKSTLEENAYEDIVGDLPKENPYEDVDLKSRRAGRKSQQLSENSLDSLHRMWSPQDRKYNSPPTQVTQP

SEQ ID NO: 783986 - protein, 107 aa, Homo sapiens
PKRNGSEMAGGMSRMSPTGEVKEERREFQNKSKSKQIAKAKQFWVLLLIHFVYIVLDKRTGKQRGPALVRKEVAFANIPMETNPDHNQLMELSPLQVYHLTSCSALH

SEQ ID NO: 783987 - protein, 103 aa, Homo sapiens
MGDYSTGSLSGPNENHCCCGLATLERRHTLPLPLVSGLGSALLSIGYSDSSGVDKGTEVSRKRERDCRQVLWLWKWVWGALTRPPAPEAHMASSSQAISSQQL

SEQ ID NO: 783988 - protein, 98 aa, Homo sapiens
MMERIRKEMILMERGLHSPTAGKRFSNLSNSAGNAVLEALENSQHPARLSPRLPSAPLHSALGELPAKGKFEIDTLFNLQHTGSESTVSSEISSAAES

SEQ ID NO: 783989 - protein, 70 aa, Homo sapiens
YIISDHHSNVARKFSFMDEKTQAWRDKSPITVGLNVKQRLSDMKIETMTPSCLLIHKGQGKVIVEGTSVY

SEQ ID NO: 783990 - protein, 106 aa, Homo sapiens [sequence omitted]

SEQ ID NO: 783991 - protein, 86 aa, Homo sapiens
EKAFPGQAGSDIPHMGPSGSNYSIGFNILHPNHVTPVSVLRFAEEGIAEGSSNPKMMHVSLVGDLPQTLSPGGSRGSVCKSTQPGH

SEQ ID NO: 783992 - protein, 101 aa, Homo sapiens
SGPGFSHHSVLPCCQGTVGKEAQSHSYFRNPSPKAPQSQLQPQSVCAVRVGRLVLEVAHLAFSVLRFHPFVVLERLCSRPSHITGKYYGPGIWKGLQLDPR

SEQ ID NO: 783993 - protein, 311 aa, Homo sapiens
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQNPDLVHSAEDCRSLRSLKISTYSNGLVAERNSCAGSSEKSRARFHALKEGQTWLKHVTRPGREAGVTCRSAWRNKGTLSHRDPIHSARAIYRDRHGDTGLTRENS

SEQ ID NO: 783994 - protein, 239 aa, Homo sapiens
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSKCLGGQLRRWGSGWVHGLDGPVRGMAVVPFYK

SEQ ID NO: 783995 - protein, 65 aa, Homo sapiens
TKVFKEVQLGEETAIQAERILRKDSEAFKELVRKDLQNFLKKENKNEKVIEHIMEDLDTNALDWV

SEQ ID NO: 783996 - protein, 104 aa, Homo sapiens
KHLTQCLAAPQLPTSKASFYFLSWIPCFVRMMSTNQNAFRKYWFTFPFFLNQDIFKCLLELWSTWNPGINILHRCNSSKKQRNKTSYIACVVLPRENSWFVFIF

SEQ ID NO: 783997 - protein, 103 aa, Homo sapiens
GRYNSSSYNSSSYNSSSYYSSSYNGCSHNSSSYNSSSYNSSSYNSSSYNSSSYNSCSYNSSSYNSSSYNSSSYNSSSYNSSCYKSFGICFLKDMLTICNFCLF

SEQ ID NO: 783998 - protein, 78 aa, Homo sapiens
YWSPWLPSPGGSVAESSAGPNVLYPPARNPRGRGDLRREAEGAVDPGLPSPGLRRVGARRRLVAEIRGEFLCVHGLRC

SEQ ID NO: 783999 - protein, 39 aa, Homo sapiens
DSHYPGVHVRINVFPFSVGKTCEYIVGPLNLQIQPATDR

SEQ ID NO: 784000 - protein, 121 aa, Homo sapiens
MAGGLLGGEGDWLLRRRGQGKGPVPQDTGRIFGGKPRTGFSPFCPLGLGARSPEGARASGRPLPPSSHRPRTEKGRPQRASRGRRPLPRAAPTAAQRPLVPGSGARAVQPACPPAAPLPAA

SEQ ID NO: 784001 - protein, 37 aa, Homo sapiens
MSTKAVQKHLVYFETSMNGLLAHHTALMVGGRRAHGL

SEQ ID NO: 784002 - protein, 76 aa, Homo sapiens
DIRPLRSLHQLPAHPPSSSAPAKSVSRCTLANRVGVSTTMGNSGSPRSADSGVNLPEEWRLTHTLWSAPPHYGSRE

SEQ ID NO: 784003 - protein, 102 aa, Homo sapiens
HNLETCLLIASIALLIGQAAWNSKGHCAGVEPLASEVIFSFEVDSCSVTQAGVQCDYRNPLQSLSPVSNLIPRSVILPRPFHLQLSLPPPTNLQPHYLCYTI

SEQ ID NO: 784004 - protein, 237 aa, Homo sapiens
IECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTT

SEQ ID NO: 784005 - protein, 102 aa, Homo sapiens
AHLHMPVPITTLGSELSGVCWSKASLKQAAMWRDSMSVVSHLSPSWPCLSTCFCGKHRAPEAGVSGACLSPGQGQHVCMDDCVPGLDLLCACFCLSAGSLLS

SEQ ID NO: 784006 - protein, 111 aa, Homo sapiens
GTGYGDAVELLKQLGIWGMDALEKRIVLKMGQMDEAFEFVKQRRSIKDGSVDVMATARGRETGCRLSAGTGGWQRGAQTALSAYAGDKRNTQAELVTRQGEKPPRPARTLQ

SEQ ID NO: 784007 - protein, 108 aa, Homo sapiens [sequence omitted]

SEQ ID NO: 784008 - protein, 52 aa, Homo sapiens
MPMQKETYAGQWTRFKGFVTVRDKSHISLCVRYSKEVVPAICRPPFTGQPLH

SEQ ID NO: 784009 - protein, 58 aa, Homo sapiens
VSLPGASVAYGCPAAPWTRGWVWTSPRGPSAASTILSKDYRYFLSTCRVPGTVLCADE

SEQ ID NO: 784010 - protein, 79 aa, Homo sapiens
PWFLEDPSLLPDSRTLRVWDRHALGAEGWVRPLCCDRAVTFSYSPPWAQFPLLENAGHADGPSSPAILSLSQLGFPDLR

SEQ ID NO: 784011 - protein, 115 aa, Homo sapiens
RNSLTSAFLFTPWARVDPRPPPHALGGGPGPHALEAPRGDSPWDPCTREEGYRHPSPPPARSSFVTPLRVPSHTSSVRDCEEWAVDSSSQPRPPTRPSLPSAPTRAAAAAAAGGR

SEQ ID NO: 784012 - protein, 199 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWWLDFVVIVFAY

SEQ ID NO: 784013 - protein, 102 aa, Homo sapiens
FCTGAFCSRRTSAPRRTSAPARKEITANLEAPAKREITDDLEAPARRDSADNLEAPAKREITDDLEAPARRDSAEFNEQVEKTGEDGSLTGEGDRKKQKCAW

SEQ ID NO: 784014 - protein, 155 aa, Homo sapiens
PTRREIAADLEVPTRREIAADLEVPTRREIAADLEVPTRREIAADLEVPTRQEIIADLEVPTRREIAADLEAPARKEITANLEAPAKREITDDLEAPARRDSADNLEAPAKREITDDLEAPARRDSAEFNEQVEKTGEDGSLTGEGDRKKQKCAW

SEQ ID NO: 784015 - protein, 126 aa, Homo sapiens
FFFEKESLSLSPRLECCGAIFTHCNLCLLSSSNSPASAFQVAGIIGACHQAQLIFLFLVETGFRQAVLELLNSSDPPASASQSAGITGVSHHTQLVWSTFLAGSFMTFLLPGSWMPMLSTSYSSGQ

SEQ ID NO: 784016 - protein, 107 aa, Homo sapiens
YHHHHHHHHNCHHYNITTGITTLSPFQHCHHYLHSGITRITTTSITSPSPSPTLLPCVLGIALATVAIKAKIKGKTFTSYDPYSMLIALCMLNPYNNALRSVFLSDS

SEQ ID NO: 784017 - protein, 103 aa, Homo sapiens
FNLQGHFTSDLSPLEKSNNTSTVTQTMRGRARIRILTVSHKPVPDMWLIIEFDRNPVAACSWLSQDLKFLDILYSLYLYWRFANFLLNSSISHNTILNIKTKT

SEQ ID NO: 784018 - protein, 98 aa, Homo sapiens
WGVAASKHPDHVFDSLCCTAIYLSLGTSELALMGVMAVDHYVAVCNPLRYNIIMNSSTCVWMVIVSWVFGFLFQIWPVYATFQLTFCKSNVLDHFYCD

SEQ ID NO: 784019 - protein, 141 aa, Homo sapiens
MGENQTMVTEFLLLGFLLGPRIQMLLFGLFSLFYIFTLLGNGAILGLISLDSRLHTPMYFFLSHLAVVDIAYTRNTVPQMLANLLHPAKPISFAGCMTQTFLCLSFGHSECLLLVLMSYDRYVAICHPLRYSVIMTWRVCI

SEQ ID NO: 784020 - protein, 198 aa, Homo sapiens
AGARAPPELTAPAPLSDPLSRGRCQMSTMGNEASYPAEMCSHFDNDEIKRLGRRFKKLDLDKSGSLSVEEFMSLPELRHNPLVRRVIDVFDTDGDGEVDFKEFILGTSQFSVKGDEEQKLRFAFSIYDMDKDGYISNGELFQVLKMMVGNNLTDWQLQQLVDKTIIILDKDGDGKISFEEFSAVVRDLEIHKKLVLIV

SEQ ID NO: 784021 - protein, 110 aa, Homo sapiens
CWVSTKGHSVGHGGDRRTGQILHLFFAGCGERAGWESHGLHQAKHCFEMLDHCAEPVDISLGLHAGNLAKKRTFFSPNAQDFVNVNYFRAFSGLLRAVVGVFEEGSFHPH

SEQ ID NO: 784022 - protein, 103 aa, Homo sapiens
MAGRAPAAVWVTGSSGAEADVGVSGLTVLRRQSTGGVGASEDETGGGNILGLAGGSQAVGTSHTCVPGARLWSCPRSLGEETAYENALGMSGTRTAVGVPSVS

SEQ ID NO: 784023 - protein, 90 aa, Homo sapiens
SLSHSLHLLFVLFEPSDLAHPQGAGLIQLQPGPVLLELSCLYHSLLPTSWPHLLKAWVRTLLSQRSSQLSPCSSTGDGLIKLTFWLMQTC

SEQ ID NO: 784024 - protein, 52 aa, Homo sapiens
CDLRIFGIHALIDPELDTNSDLGITAQSYSRVHINNRVYNLDVGSGHPNGVT

SEQ ID NO: 784025 - protein, 98 aa, Homo sapiens
LDGAAGSRVSAGEGAVRVQGEPTHVMGIPGLTRETVVVLMVFQCAHEKSEAQRSAARSQGHTAQAVEIRTLSPVSHTSLLLLGPTFQPWHVGVLVTFC

SEQ ID NO: 784026 - protein, 186 aa, Homo sapiens
PTWHLQPSFQHPGQGGALRGLSMPHTDHGPRMATSFSQLWLPREQEWRSWRRGSCPPARCSLTTPAADAQGPQGPPAPCIAAATTGPSRAFAPAQKEGASAMHPRGSGSCSCGQTPRPWQETRWLSTWLNQLPGHCLVTSQRLLTVPGDGSSAGLICSPLVTCPTQTTGAGQRPSRCTKQGWPKCP

SEQ ID NO: 784027 - protein, 64 aa, Homo sapiens
DQLVHYYRVSGLHGQKSSQCHWFRCSCHPCPFTEPFLTQSQMREVIWQRLFSQLPATSSEHSTG

SEQ ID NO: 784028 - protein, 43 aa, Homo sapiens
MTMRPRQAGLIQAGLTRLDFHKFQTAPIPNSSVCGQEARQGPM

SEQ ID NO: 784029 - protein, 83 aa, Homo sapiens
WQELRTRYGEETDGSHRPALPRQAKDVEVVLRRWGALQACVGVGTGRGGGLHPQCRERRRYRGRDGGWLSLPAYYCAVLRLRC

SEQ ID NO: 784030 - protein, 102 aa, Homo sapiens
DYMHEPPRLAPPTLFLKSLALSPRLESGGTITAHCSFNLLGSGDLPTSASLVALTTGAPYCAWLIFLLVCFCFRPSFLLFFLRLECTGAISAHCNLLTPRFK

SEQ ID NO: 784031 - protein, 102 aa, Homo sapiens
MSLSLNVLICKVGITLSQCCYTFNVMTHTMSWHGKQHLVGSAGRLPPFHHHSSLPNAISAHCSLHLPGSSDSPASASRVAGITGACHHAWLIFVFLLEMGFH

SEQ ID NO: 784032 - protein, 101 aa, Homo sapiens
LDWDCTVTALASGVTRASWGSGESDPCESRWTETSQRERLRRLEQAVLKLRAVSKASQMCWGEAACLANPSAFCLIDGFGCLWNRGLGGRALLTLCYVEGM

SEQ ID NO: 784033 - protein, 207 aa, Homo sapiens
NAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQ

SEQ ID NO: 784034 - protein, 178 aa, Homo sapiens
SHTVWRQEVGPGQPRGGGGGSCHSCWAPGCLSGSSGHGAWAPFGLRVWAAEDCGHPGAQRGTTEEPHRGRAPPAALHPRKRKPAPDGNRERSGLLQAGRWGLSRVAEPPAPSHRPPGQLGTPRTPPLHPLLTSAGKMAGRAPRLPQPRLSRRSAENPLYFASWALSTRAAGSSIAGSG

SEQ ID NO: 784035 - protein, 91 aa, Homo sapiens
DCHSQPGWGRNSLEESFPEQVLGLDQLGGVERLFQASHAQGICYCRSVWLHQGDREETSLETKWRPEPVESCLYSLGNGSHVGFRKTYLKT

SEQ ID NO: 784036 - protein, 105 aa, Homo sapiens
CFISSLLPAHPLPSLVYGIPWPRVRHSCPHPKQCLGRGEGDPLPWRAGPCKAATVMRKSREVVSASLACRLLGEYAIQESRPQPKHPFHTQTSIHPWTRRHVLTV

SEQ ID NO: 784037 - protein, 95 aa, Homo sapiens
SIGGYDITRLIEAHRICKVLARPKMLGKCRVEGAPGVTHVFHRYKVFAFLHSFQRFPGIQDAPSAVSAHSESYILGNKNMSGVGKIMKTKLPVTK

SEQ ID NO: 784038 - protein, 137 aa, Homo sapiens
AVQRLRAFRAACCLCGAECSPQGHPYRWALPLGLHCPARGSLARGPTRQEVIPLQESETLWRYGLRVPHLQFQEKPKTNRPDARNKPQPTALRKPQALCVFREWLHPSWNLSSASVTHTAATPSPEPTAHLSPRHTC

SEQ ID NO: 784039 - protein, 113 aa, Homo sapiens
SPLPKPLTPTSGPASPSPPCPCSELGQSRPGTEKNMGASITPGGSQVRPGTEKNMGASVTPGGSQVRPGTEKNMGASVTPARSQVRPGTTHACVSSLMVLNFICIIVHFHTGN

SEQ ID NO: 784040 - protein, 107 aa, Homo sapiens
EDTLRILCRGLCLLCLPPCTLRGHRPLLWFAGDTLRLYLEKGSGREKLLPLPPGMVAKGLRQAPHGMWGASAPGPPARDVECQCVLISVLKSQAFWDDFFDVLKRRF

SEQ ID NO: 784041 - protein, 45 aa, Homo sapiens
FSVQTVPKKAAPKSRQPQPPDRYLLETPRNQGQGSKRLQAAARSA

SEQ ID NO: 784042 - protein, 52 aa, Homo sapiens
PSVSRHQRITRSLPISRHHRITKSLYVSQHHHIRRSPFIGFTASAGPVHQSA

SEQ ID NO: 784043 - protein, 105 aa, Homo sapiens
MAYKLYLGALVYCCSLIWCPLTSCWLHPGLACHLWIPLTCATSFFLKAFGCLVPSSLIVPPLSPFLPPPLPLLSPHHHSCQSGMLLYLLCQALCLAFGRYSINTC

SEQ ID NO: 784044 - protein, 94 aa, Homo sapiens
CSQNTEAEIIIPSCIGINESANVGDQALRKMMTGVVDLDYCIADEAVETATYADKKWPIRHGIVEDWDLMERFMEQVIFKYLRAEPEDHYFLLV

SEQ ID NO: 784045 - protein, 39 aa, Homo sapiens
TFKMRALTLTRYYSPILTAHPELPTDLMRSSMETQPLIP

SEQ ID NO: 784046 - protein, 102 aa, Homo sapiens
RGSSVSCGSRSSSPAVSVSRRNVNNAEPPTSGGSQSQWSSRDRVTVCTGIGDWHYAIRSHSAYYPWKEFGKLFFLRQGLALSSRLEYSGVIIALCNLKLLDS

SEQ ID NO: 784047 - protein, 533 aa, Homo sapiens
RPRGRECSPTSSLERLCRHKHQRERSHERPDRKESVAWPRDRRKRRSRSPSSEHRAREHRRPRSREKWPQTRSHSPERKGAVREASPAPLAQGEPGREDLPTRLPALGEAHVSPEVATADKAPLQAPPVLEVAAECEPDDLDLDYGDSVEAGHVFDDFSSDAVFIQLDDMSSPPSPESTDSSPERDFPLKPALPPASLAVAAIQREVSLMHDEDPSQPPPLPEGTQEPHLLRPDAAEKAEAPSSPDVAPAGKEDSPSASGRVQEAARPEEVVSQTPLLRSRALVKRVTWNLQESESSAPAEDRAPRAPLHRPQKPREGAWDMEDVAPTGVRQAFSELPFPSHVLPEPGFPDTDPSQVYSPGLPPAPAQPSSIPPCALVSQPTVQFILQGSLPLVGCGAAQTLAPVPAALTPASEPASQATAASNSEEKTPAPRLAAEKTKKEEYMKKLHMQERAVEEVKLAIKPFYQKREVTKEEYKDILRKAVQKICHSKSGEINPVKVANLVKAYVDKYRHMRRHKKPEAGEEPPTQGAEG

SEQ ID NO: 784048 - protein, 138 aa, Homo sapiens
WAEQVMVGDQWLGAGTPRNLPLVLGVDLRAALWSLLLVLFWIFPAMKQHSGQGWAQSTHLPVCRAPRGTTSQATEAPRRSLGHGGCGPHRGQAGVLRAALSQSRASGTRVPRHRPLSGGCLGWRAVGRGQWPGTRATH

SEQ ID NO: 784049 - protein, 109 aa, Homo sapiens
IGGRSRKQGGGSGDGQVRSDGAVFGREAGSEEQRAVPETWEALPMGQGYTGFLAGLSVFLQALDTPHREKGSWKQSNPARGLFLKGQSRGWKTCKPSLRVTAFPRATLP

SEQ ID NO: 784050 - protein, 46 aa, Homo sapiens
YVNVWKQKSTWGDAVCITRLQSPYYPRAPGNCARLPQRCRARERGK

SEQ ID NO: 784051 - protein, 164 aa, Homo sapiens
ICPASEDSRHSPVGLRLPRPRGTAGPGRSWSAVGEGRGGVGPSGPRRSRSAGPERAGPQLPANRNSLGAATATAAGTEGGEAARSKRAAHRVKTGRGAPRGPSEEGGGRPGARTLELCGRPREEPGPERLCELRAPAPRGPVPRAPLRIAGSRPRRRRGGARLG

SEQ ID NO: 784052 - protein, 132 aa, Homo sapiens
MVTAVAYRLAEQHRQIEETLAHFHLTKDMLLEVKKRMRAEMELGLRKQTHNNAVVKMLPSFVRRTPDGTEEMGDFLWAPGIFGREPKFSRAALLGKMLDGELFKKFEPLQGHCQKPLGNLGPVRFLTKPFGT

SEQ ID NO: 784053 - protein, 960 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784054 - protein, 961 aa, Homo sapiens
SYKSVLENVYRRGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784055 - protein, 905 aa, Homo sapiens
MAKRALHDFIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784056 - protein, 905 aa, Homo sapiens; identical to SEQ ID NO: 784055

SEQ ID NO: 784057 - protein, 905 aa, Homo sapiens; identical to SEQ ID NO: 784055

SEQ ID NO: 784058 - protein, 921 aa, Homo sapiens
MGQICQRESATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784059 - protein, 879 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784060 - protein, 960 aa, Homo sapiens; identical to SEQ ID NO: 784053

SEQ ID NO: 784061 - protein, 960 aa, Homo sapiens; identical to SEQ ID NO: 784053

SEQ ID NO: 784062 - protein, 969 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRHPRPLLLSRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784063 - protein, 519 aa, Homo sapiens
NSSSSFESRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784064 - protein, 415 aa, Homo sapiens
VWVTLAGSLSSPFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784065 - protein, 406 aa, Homo sapiens
ARYGRNSGSDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784066 - protein, 371 aa, Homo sapiens
IGLGTRPGSSNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784067 - protein, 960 aa, Homo sapiens; identical to SEQ ID NO: 784053

SEQ ID NO: 784068 - protein, 252 aa, Homo sapiens
MQGHRSSLPPRVFRTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784069 - protein, 211 aa, Homo sapiens [sequence omitted]

SEQ ID NO: 784070 - protein, 866 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRHLVGYQRDPRGNPNRKTGFEQFWNENTDNAQRYQTSRTGRLKRGDRQLRSRKDSATGAHHETGLLRPL

SEQ ID NO: 784071 - protein, 490 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQFPAFQLTSSDSCLTHLHHPPNYLYT

SEQ ID NO: 784072 - protein, 109 aa, Homo sapiens
TRLTKRWEIPVMALFVGWFLLSKWRQDTFPQDCPPPSRGHCLKASVGIALAASSPPGTHCGLASHRGVSMPQNRVSVEPVLAACDSLAFCLSRGGRWTVLRKCVLSPFG

SEQ ID NO: 784073 - protein, 956 aa, Homo sapiens
LANVLSGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784074 - protein, 921 aa, Homo sapiens; identical to SEQ ID NO: 784058

SEQ ID NO: 784075 - protein, 921 aa, Homo sapiens; identical to SEQ ID NO: 784058

SEQ ID NO: 784076 - protein, 960 aa, Homo sapiens; identical to SEQ ID NO: 784053

SEQ ID NO: 784077 - protein, 960 aa, Homo sapiens; identical to SEQ ID NO: 784053

SEQ ID NO: 784078 - protein, 960 aa, Homo sapiens; identical to SEQ ID NO: 784053

SEQ ID NO: 784079 - protein, 1000 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDQQWVVRGQSCVHRFVCRTLTSGSSFKEGARGKGGIGTFHCGGPFTNGFSFPSFSSAALWTPKDQRKPLNGFPKGAAGGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784080 - protein, 960 aa, Homo sapiens; identical to SEQ ID NO: 784053

SEQ ID NO: 784081 - protein, 418 aa, Homo sapiens
RDWRHWNGAAKMQASFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784082 - protein, 814 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTGTGSNACYMEEMKNVEMVEGDQGQMCINMEWGAFGDNGCLDDIRTHYDRLVDEYSLNAGKQRHPRPLLLSRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784083 - protein, 960 aa, Homo sapiens; identical to SEQ ID NO: 784053

SEQ ID NO: 784084 - protein, 231 aa, Homo sapiens
MNAYIRNGCHYTSHVGDQINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 784085 - protein, 112 aa, Homo sapiens
ISNRVIIGWRWKITPPDRPSGPPKPILGVPPPCVKCIITSRHCRASLPGALPEGECGHSISCFLPSWHPLWPGIASWCVNATKSCVRGARRARPPHLPCHFAWFDFDLVPHV

SEQ ID NO: 784086 - protein, 275 aa, Homo sapiens
SLIKLILPPPGGAAEQPPEDHGSPGLRRTDRPHACRPATPTASMIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHSTPHYNAWD

SEQ ID NO: 784087 - protein, 110 aa, Homo sapiens
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQISTN

SEQ ID NO: 784088 - protein, 110 aa, Homo sapiens; identical to SEQ ID NO: 784087

SEQ ID NO: 784089 - protein, 110 aa, Homo sapiens; identical to SEQ ID NO: 784087

SEQ ID NO: 784090 - protein, 126 aa, Homo sapiens
MGRSPRKIDQFCNSSNMVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQISTN

SEQ ID NO: 784091 - protein, 91 aa, Homo sapiens
MQAWGRPGLALKGLTVNRGGRRAGCLMWGDRRGADQQGGASLGWSCLSSVPNKDAVGAGGSSRRRERQHKGHKVAEAASCTDNSSVLQAHA

SEQ ID NO: 784092 - protein, 43 aa, Homo sapiens
GEEGAFAPGLGGRTQSQAGRNPCAAIRCLHVPGAEGTPHQPRR

SEQ ID NO: 784093 - protein, 107 aa, Homo sapiens [sequence omitted]

SEQ ID NO: 784094 - protein, 78 aa, Homo sapiens
GGYTCQSGSGWDEFTKHVTSECLGWMRQQRAEMDLVAWGVGAMNEANRFSFILVLRVCYNFLFLWALVREVGVVCVIF

SEQ ID NO: 784095 - protein, 107 aa, Homo sapiens
GGYTCQSGSGWDEFTKHVTSECLGWMRQQRAEMDMVAWGVDLASVEQHINSHRGIHNSIGDYRWQLDKIKADLREKSAIYQLASSSSIHLKAQVYSLFSLPKVGTPS

SEQ ID NO: 784096 - protein, 44 aa, Homo sapiens
FFSPGLSDDASARCQCSLPVLPDTGASEHLTGDYCNWELSLSPF

SEQ ID NO: 784097 - protein, 111 aa, Homo sapiens
MCAFPWLLLLLLLQEGSQRRLWRWCGSEEVVAVLQESISLPLEIPPDEEVENIIWSSHKSLATVVPGKEGHPATIMVTNPHYQGQILTMLLRSLQQPSASWPRDCSSSCSW

SEQ ID NO: 784098 - protein, 138 aa, Homo sapiens
MSLVCSVEKAGMDMTYSWLSRGDSTYTFHEGPVLSTSWRPGDSALSYTCRANNPISNVSSCPIPDGPFYADPNYASEKPSTAFCLLAKGLLIFLLLVILAMGLWVIRVQKRHKMPRMKKLMRNRMKLRKEAKPGSSPA

SEQ ID NO: 784099 - protein, 289 aa, Homo sapiens
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYRWLSEPQITVNFESSGEGACSMSLVCSVEKAGMDMTYSWLSRGDSTYTFHEGPVLSTSWRPGDSALSYTCRANNPISNVSSCPIPDGPFYADPNYASEKPSTAFCLLAKGLLIFLLLVILAMGLWVIRVQKRHKMPRMKKLMRNRMKLRKEAKPGSSPA

SEQ ID NO: 784100 - protein, 128 aa, Homo sapiens
MQSRGQYSCTGQVMYIPQTFTQTSETAMVQVQGSQRRLWRWCGSEEVVAVLQESISLPLEIPPDEEVENIIWSSHKSLATVVPGKEGHPATIMVTNPHYQGQILTMLLRSLQQPSASWPRDCSSSCSW

SEQ ID NO: 784101 - protein, 156 aa, Homo sapiens
TVGSHLLRLLSLSQGGEKRSGIHCQEGLPPGFPTSFFTAVLEAHRRPLKRWSPAHSPPHPPPATPTVPNASSALSSVFFPSREMVVVMKFFRWVRRAWQRIISWVFFWRQKIKPTISGHPDSKKHSLKKMEKTLQVVETLRLVELPKEAKPKLGES

SEQ ID NO: 784102 - protein, 113 aa, Homo sapiens [sequence omitted]

SEQ ID NO: 784103 - protein, 142 aa, Homo sapiens [sequence omitted]

SEQ ID NO: 784104 - protein, 33 aa, Homo sapiens
IKQPCSLTPIKIQGLPLSQPTFCLVLVFGHIPL

SEQ ID NO: 784105 - protein, 210 aa, Homo sapiens
MRKRQQSQNEGTPAVSQAPGNQRPNNTCCFCWCCCCSCSCLTVRNEERGENAGRPTHTTKMESIQVLEECQNPTAEEVLSWSQNFDKMMKAPAGRNLFREFLRTEYSEENLLFWLACEDLKKEQNKKVIEEKARMIYEDYISILSPKEVSLDSRVREVINRNLLDPNPHMYEDAQLQIYTLMHRDSFPRFLNSQIYKSFVESTAGSSSES

SEQ ID NO: 784106 - protein, 131 aa, Homo sapiens
PGCCGPTNHKSYERGSRRREKSQYRLVPATFGKKKFLTRRGACFALGRVALAGAWVTPIPPWRLTSCRGGPPASSWPRAQGASCPGTADAGIASPGRAGGEGGRGGRGTAGCSPPWGIRGAEPRWRPRGPG

SEQ ID NO: 784107 - protein, 116 aa, Homo sapiens
MKANWQDSSFSIKISKLLPAHILFLPASTACTHVPLFSNTRPLGSDPAPSFLLDGGAPAILFPTPASPSSPFSKHLSTISTLKSFRIFHLKIKNRPGMVAHTCCPSTLGGQCGQIA

SEQ ID NO: 784108 - protein, 90 aa, Homo sapiens
LPTWTTPLTWATPHFHSCPQHTPAAPIASSNPLQLKVLTHLSPVQEGPLRPLGVKSKLPITAHQACKEEDDLQKPFTKSACKGEKKQAAE

SEQ ID NO: 784109 - protein, 456 aa, Homo sapiens
MTSSYSSSSCPLGCTMAPGARNVSVSPIDIGCQPGAEANIAPMCLLANVAHANRVRVGSTPLGRPSLCLPPTCHTACPLPGTCHIPGNIGICGAYGENTLNGHEKETMQFLNDRLANYLEKVRQLEQENAELEATLLERSKCHESTVCPDYQSYFHTIEELQQKILCSKAENARLIVQIDNAKLAADDFRIKLESERSLRQLVEADKCGTQKLLDDATLAKADLEAQQESLKEEQLSLKSNHEQEVKILRSQLGEKLRIELDIEPTIDLNRVLGEMRAQYEAMLETNRQDVEQWFQAQSEGISLQDMSCSEELQCCQSEILELRCTVNALEVERQAQHTLKDCLQNSLCEAEDRFGTELAQMQSLISNVEEQLSEIRADLERQNQEYQVLLDVKTRLENEIATYRNLLESEDCKLPCNPCSTSPSCVTAPCAPRPSCGPCTTCGPTCGASTTGSRF

SEQ ID NO: 784110 - protein, 518 aa, Homo sapiens
MTSSYSSSSCPLGCTMAPGARNVSVSPIDIGCQPGAEANIAPMCLLANVAHANRVRVGSTPLGRPSLCLPPTCHTACPLPGTCHIPGNIGICGAYGENTLNGHEKETMQFLNDRLANYLEKVRQLEQENAELEATLLERSKCHESTVCPDYQSYFHTIEELQQKVRCGIAWVCWVCDGRGKTGGIHVSSENFGFLVSLGHDHRHHTWRRSLGHDDFVCELSSCSPQILCSKAENARLIVQIDNAKLAADDFRIKLESERSLRQLVEADKCGTQKLLDDATLAKADLEAQQESLKEEQLSLKSNHEQEVKILRSQLGEKLRIELDIEPTIDLNRVLGEMRAQYEAMLETNRQDVEQWFQAQSEGISLQDMSCSEELQCCQSEILELRCTVNALEVERQAQHTLKDCLQNSLCEAEDRFGTELAQMQSLISNVEEQLSEIRADLERQNQEYQVLLDVKTRLENEIATYRNLLESEDCKLPCNPCSTSPSCVTAPCAPRPSCGPCTTCGPTCGASTTGSRF

SEQ ID NO: 784111 - protein, 108 aa, Homo sapiens
KLDKWQITHCPSHALQPQPRGCRGVTIHWSISCAPATVGVRWCAVSSILRRSTRMKRLRSKREKRFLVCILPFLKAHVWAPTFFRIFSLAQLKLNSYHTKERLGLQTP

SEQ ID NO: 784112 - protein, 119 aa, Homo sapiens
MRDFNTLLTVLDTSLRQKISKDIQDLNSALDQMDLIDVYRTLHQKATEYTFFSSPHGTYSETVSWRKLFHGEEATGLTGNQTLTSLCTCPEAGSCAQWVLSVPRWSCSLFREACFWAHT

SEQ ID NO: 784113 - protein, 113 aa, Homo sapiens [sequence omitted]

SEQ ID NO: 784114 - protein, 59 aa, Homo sapiens
MGTIVILRGVVVKTKAAVSVPAHSERSVSVRWVAYVLDLLRLSASCLYSFLLGRESLLM

SEQ ID NO: 784115 - protein, 322 aa, Homo sapiens
KPVPEAWHSRRPPLQCLGVRALRLRPDLFMGSTATSPDARSHKGPTRMRKPQAESRGSSTASQPHACPDGVGSAVNRRHFSAPQKLHADCEKEMLDGGVPGTTVREMVRELWMWNVEYGGTRSGDLHLGWSALRMPSKGTAWSTSRSGLCARVGIAADGETFGVAEECPQTLEGIRCLLHSRVSLPRAIISGSRKSGSWARAGWLEPLARRTAEVQAAPVSQAAVSDASLVPEGSQEVCRPGLTSGQHGGRDEKVTGFAAPGDPAEPPGHPASPAAPRGGLALVTWRPVHKAHDSVPEASPSSANFRNPGPAEARPRARQRA

SEQ ID NO: 784116 - protein, 87 aa, Homo sapiens
SPAGIATPGQANNTKKTSPVVNKNALTCLKFLRNYRTHTRTKSNGFCNSNINVDTDKVNPHQEELGVLRHRELLQTRAVFYSRTNSE

SEQ ID NO: 784117 - protein, 69 aa, Homo sapiens
PMSPFLFEDKLTEIYSDRTFAPLPEFEQEEDDGEVTEDSDEDFIQPRRKRLKSDERPVHIKKNDMDLFY

SEQ ID NO: 784118 - protein, 159 aa, Homo sapiens
AHSSTAAHSSTHQHKAAHASAQQRTPVHSSTQHHTAAYSSARQSTVAHASAQQHTAAHSSTRQGTAAHASTRQRTAAHSSTRQRTAAHASAQRTAAHSTQQHTAAHTSAQQRTAAHASTQQHTAHSSAQQHTPAHSSTRQRTAAHSSTRQHTPAHSSTR

SEQ ID NO: 784119 - protein, 68 aa, Homo sapiens
FVCFDQSCFFRETHGFCRRPSLAYGLIDTCPLTEAWMDTALGPLENRTWRVLEMAVDMPGSLPMMWHP

SEQ ID NO: 784120 - protein, 102 aa, Homo sapiens
GRGWGRGRGESRSRPLPTTKLLCQSPRAAVTEDHELGGLKQLKCVFSQFWRPEVSNQGARRAMRSLKHIGEVLSFLSSFQCLMGTLGLRLRYFSLSRRLVIF

SEQ ID NO: 784121 - protein, 37 aa, Homo sapiens
MRTTLGSTGVSSCSCLFLSLSLLASTLSIRKPQLVCV

SEQ ID NO: 784122 - protein, 109 aa, Homo sapiens
VWDFASVSLGNSFSGKLLSIPAPSWDWAICLSPCSCQFLSPACHPRTDSSDVDCLVDCLPHCNHALRLGFYFTLDYHHNCLWDFPPFHLSIHPSIRLVDAAANLVVVGG

SEQ ID NO: 784123 - protein, 53 aa, Homo sapiens
LTVRAVEKWGDPRVSVLGCKTCSTPEKIAVGLILAEFYLGLIDPKTDPPGLFK

SEQ ID NO: 784124 - protein, 80 aa, Homo sapiens
TGEFHLTEIRTPVHKDACPVMPAAAKEKNKVQSRPHTRGWATRRTPCHMRDRVPPESRRRPGGALAHSAEGAKRTQEECA

SEQ ID NO: 784125 - protein, 79 aa, Homo sapiens
EDSVDISLSTLYAANCMISWFLEFWGYRQKGKEVSKEDNRSKVSCAADNSAKNKETMAWDRVLFRAYSYCLLLALLSQR

SEQ ID NO: 784126 - protein, 195 aa, Homo sapiens
AVQVELEPVNAQARKAFSRQREKMERRRKPQLDRRGAVIQSVPGFWANVIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 784127 - protein, 283 aa, Homo sapiens
VSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAG

SEQ ID NO: 784128 - protein, 116 aa, Homo sapiens
LSGSATPGPSWAPSWPQEPKAGCTIHWAQAIRSTDSTWRSTPLTAAGYGGQELTSLVRTQIPGASASREGKAAWSRRGSTSGGTPGLGGMSWVQRQLIGHRRPNRGPGSSRGRVYA

SEQ ID NO: 784129 - protein, 52 aa, Homo sapiens
LFAWISPAEAAEQQILQNGKFCCLILLLKASSQRGTWLYEVSVGPYWEVSPI

SEQ ID NO: 784130 - protein, 69 aa, Homo sapiens
QGDVLVEVFSLHSGGTRTEEKKGIFRLNFKRGSFFFPENSWSPGTWPSQSLRPEVRNQHAYKIQPRIFL

SEQ ID NO: 784131 - protein, 44 aa, Homo sapiens
MCCTVSRASVAPQLMAQEGQLTQGKQTPKQGDESTQMVTSRIFR

SEQ ID NO: 784132 - protein, 132 aa, Homo sapiens
KNKKKFGVESDKRVTNDISPESSPGVGRRRTKTPHTFPHSRYMSQMSVPEQAELEKLKQRINFSDLDQINTNKSKDASTNPPNRETIGSAQCKELFASALSNDLLQNCQVSEEDGRGEPAMESSQVITFVSF

SEQ ID NO: 784133 - protein, 141 aa, Homo sapiens
MGVRGTWEVELSCGVGNDLPAPPAPAVRPVSGKTSSCSRLPEAPRQREAHPAQGRPSMRPGAEVPPLQVCRTRQGLTHRAVPLCAMSLRALRLKLGHPQTLHISTWSFLGFKRAHFPIPSSAQLLSRLSIVHTPLKLWRSC

SEQ ID NO: 784134 - protein, 317 aa, Homo sapiens
ARRPPPGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRVSGPGAANDHFIL

SEQ ID NO: 784135 - protein, 117 aa, Homo sapiens
MKARRNKKQIPSFRKLIKTSKVKLENKLKNKQFKQQSTLKKYRKEQRKLRQAVKDAVSKKPIPLENPKEKRPGKRIEREEEEEEEALPLDMMDEDDLQLMKDLGQRVSFLTRDLSSR

SEQ ID NO: 784136 - protein, 70 aa, Homo sapiens
RAISPPFEWDLSQHTAFYTVSEEKAKPRYSNKDCIQSQKNYLLTPVSSFTTYRNVEEMDSTLRERKTGLI

SEQ ID NO: 784137 - protein, 116 aa, Homo sapiens
GGVGQRVSVVSGAWSVHFAIAALANSCRCPGPEQAGELWTGSRQWLGAHGMGTLVLTVTPVPFDLRNCGSFQPVISCYDRDLNPSSGWGHEMFARPAQGQALGYGTALLIVVEPRK

SEQ ID NO: 784138 - protein, 295 aa, Homo sapiens
MSGALDVLQMKKEDVLKFLAAGTQLGGSNLDFQVEQYVYKRKSDGIYIINLTRTWKKLLLAARAIVAIENAAAVSVISSRNTGQRVVLKFAAATGATPIAGPFTPGTFTNQIQAAFWEPRLLVVTDPRADQQPLRTEASYVNLPTIALCNTDSPLRYVDIAIPCNNKGAHSVGLMWWMLAREVLRMRGTISREHPWEVMPDLYFYRDPEEIEKEQAAAEKAVTKEEFQGEWTAPAPEFTATQPEVADWSDGVQVPSVPIQQFPTEDWSTQPATEDWSAAPTAQATEGVGATTEWS

SEQ ID NO: 784139 - protein, 101 aa, Homo sapiens
GAISAHRNLRLPDSSDSPASASSGAGITGAHRHARLIFVFLVETGFHYIGQAGLELLTSSNPPASASQSAGITDVIHQDHTRPRLACFHFKSQICHPPQCL

SEQ ID NO: 784140 - protein, 207 aa, Homo sapiens
MKQPNRKRKLNMDSKERLDQDGRLEQAEEEKKPKDSTTPLSHVPSAAAQGAWSWEWYLKEQKAVAAPVELFSKDQSFPEHENGFQIGMRLEGIDPRHPSVFCVLSVAEVCGYRLRLHFDGYLSCYDFWTNAGSPDIHPVGWCEKTKHELHIPKGYRKDKFVWMDYLKACKLQNAPKKLFRNRSPNGPMSKEFQVGMKLEAVDRKNPS

SEQ ID NO: 784141 - protein, 58 aa, Homo sapiens
NEIKRLKEMTLVPLSLHNPFPAWQPADRLDLTTRHFRGSFLHSSRRPFGALHAAECTC

SEQ ID NO: 784142 - protein, 109 aa, Homo sapiens
NFVFVVETGFHHVGQAGLKLLTSGDLPASASQNAGITGVSHHTWPTLINFLMNIPPSVSVHCLITTNGSLNYFRIKFNLFLLTLEGLYDLAIDFVPKGFLILKGLSTVF

SEQ ID NO: 784143 - protein, 118 aa, Homo sapiens
ALRLLSFRDFAELPPALGCPGARRTVPRDPPQLQPLGFPCEIPAPTRDSEIAWSPLPGPSAPPPALHSTNGREAFPAPLGSHPLPNDTLSLMGLAFCCVPKQVRREHSLNVKGSAAEG

SEQ ID NO: 784144 - protein, 55 aa, Homo sapiens
VTFQQSPKASLSQGDNCQKNVPSSTRVPGQAHAWCVWCGGESQQGANELESSDGG

SEQ ID NO: 784145 - protein, 86 aa, Homo sapiens
HLLSSVVAITEAGAAKMKFNPFVTSDRSKNRKRHFNAPSHIRRKIMSSPLSKELRQKYNVRSMPIRKDDLKFRLYVDTIKVSKLAK

SEQ ID NO: 784146 - protein, 89 aa, Homo sapiens
AAATTTKFAARRPPKREAKMKFNPFVTSDRSKNRKRHFNAPSHIRRKIMSSPLSKELRQKYNVRSMPIRKDDLKFRLYVDTIKVSKLAK

SEQ ID NO: 784147 - protein, 122 aa, Homo sapiens
MLKSLREGYDATLRSVRSLSLLGRICYEDVSPLGDYENELAGEAITEAGAAKMKFNPFVTSDRSKNRKRHFNAPSHIRRKIMSSPLSKELRQKYNVRSMPIRKDDLKFRLYVDTIKVSKLAK

SEQ ID NO: 784148 - protein, 98 aa, Homo sapiens
LNPLFYYAARRQKGLFPFAAITEAGAAKMKFNPFVTSDRSKNRKRHFNAPSHIRRKIMSSPLSKELRQKYNVRSMPIRKDDLKFRLYVDTIKVSKLAK

SEQ ID NO: 784149 - protein, 94 aa, Homo sapiens
RDPELVNSVTQDVVRVSWQLMEAKMKFNPFVTSDRSKNRKRHFNAPSHIRRKIMSSPLSKELRQKYNVRSMPIRKDDLKFRLYVDTIKVSKLAK

SEQ ID NO: 784150 - protein, 86 aa, Homo sapiens
GARPVDSIRPDALSSKMKFNPFVTSDRSKNRKRHFNAPSHIRRKIMSSPLSKELRQKYNVRSMPIRKDDLKFRLYVDTIKVSKLAK

SEQ ID NO: 784151 - protein, 89 aa, Homo sapiens; identical to SEQ ID NO: 784146

SEQ ID NO: 784152 - protein, 100 aa, Homo sapiens
TTTKLPAASTDDEVQVVRGHYKGQQIGKVVQVYRKKYVIYIERVQREKANGTTVHVGIHPSKVVITRLKLDKDRKKILERKAKSRQVGTRNKGQIQGRNH

SEQ ID NO: 784153 - protein, 85 aa, Homo sapiens
GLHGIGHEPKRGRPKMKFNPFVTSDRSKNRKRHFNAPSHIRRKIMSSPLSKELRQKYNVRSMPIRKDDLKFRLYVDTIKVSKLAK

SEQ ID NO: 784154 - protein, 156 aa, Homo sapiens
AFLREWVESMGGKVPPATQKAKSEENTKEEKPDSKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKSPSRNTEQGANTRKKPLRRCRN

SEQ ID NO: 784155 - protein, 85 aa, Homo sapiens; identical to SEQ ID NO: 784153

SEQ ID NO: 784156 - protein, 122 aa, Homo sapiens
NLFPSLLPSLKLRAPLAPRDIGLARSLVNLQNRKQRVVLFPFAAITEAGAAKMKFNPFVTSDRSKNRKRHFNAPSHIRRKIMSSPLSKELRQKYNVRSMPIRKDDLKFRLYVDTIKVSKLAK

SEQ ID NO: 784157 - protein, 122 aa, Homo sapiens; identical to SEQ ID NO: 784156

SEQ ID NO: 784158 - protein, 128 aa, Homo sapiens
MRAHSKTQTQESTRTTREKKSNSSRGETQTAQPAECTHNPAANISERRPHSAQQTAASNTETKSERQADPPEQTKDNCEQVREHKKHNAYAHKKMQRDNITEQPRNQQKHERPTTDDTSNVTIDTDDL

SEQ ID NO: 784159 - protein, 85 aa, Homo sapiens; identical to SEQ ID NO: 784153

SEQ ID NO: 784160 - protein, 93 aa, Homo sapiens
HLARSCLTEPVPFAAITEAGAAKMKFNPFVTSDRSKNRKRHFNAPSHIRRKIMSSPLSKELRQKYNVRSMPIRKDDLKFRLYVDTIKVSKLAK

SEQ ID NO: 784161 - protein, 181 aa, Homo sapiens
MKFNPFVTSDRSKNRKRHFNAPSHIRRKIMSSPLSKELRQKYNVRSMPIRKDDLKFRRFQCLVIEEAVEDQYNRIAPNLDSGAVTEAQSRYRLHLQVVRGHYKGQQIGKVVQVYRKKYVIYIERVQREKANGTTVHVGIHPSKVVITRLKLDKDRKKILERKAKSRQVGTRNKGQIQGRNH

SEQ ID NO: 784162 - protein, 85 aa, Homo sapiens
SIRNPTRRPKREAAKMKFNPFVTSDRSKNRKRHFNAPSHIRRKIMSSPLSKELRQKYNVRSMPIRKDDLKFRLYVDTIKVSKLAK

SEQ ID NO: 784163 - protein, 113 aa, Homo sapiens
GRLLLLLLEFKLLTMYGDMPIRKDDEVQVVRGHYKGQQIGKVVQVYRKKYVIYIERVQREKANGTTVHVGIHPSKVVITRLKLDKDRKKILERKAKSRQVGTRNKGQIQGRNH

SEQ ID NO: 784164 - protein, 91 aa, Homo sapiens
GRVGRPTRRPTRPITEAGAAKMKFNPFVTSDRSKNRKRHFNAPSHIRRKIMSSPLSKELRQKYNVRSMPIRKDDLKFRLYVDTIKVSKLAK

SEQ ID NO: 784165 - protein, 122 aa, Homo sapiens; identical to SEQ ID NO: 784156

SEQ ID NO: 784166 - protein, 94 aa, Homo sapiens
EREHNGMSESVWISGRGTEAGAAKMKFNPFVTSDRSKNRKRHFNAPSHIRRKIMSSPLSKELRQKYNVRSMPIRKDDLKFRLYVDTIKVSKLAK

SEQ ID NO: 784167 - protein, 105 aa, Homo sapiens
RKPWDERHFDRTLQFGHYEPGLFPFAAITEAGAAKMKFNPFVTSDRSKNRKRHFNAPSHIRRKIMSSPLSKELRQKYNVRSMPIRKDDLKFRLYVDTIKVSKLAK

SEQ ID NO: 784168 - protein, 96 aa, Homo sapiens
DPNSDPTGSTQVVRGHYKGQQIGKVVQVYRKKYVIYIERVQREKANGTTVHVGIHPSKVVITRLKLDKDRKKILERKAKSRQVGTRNKGQIQGRNH

SEQ ID NO: 784169 - protein, 75 aa, Homo sapiens
LPLLLLNSRPVDHRSGRRVQREKANGTTVHVGIHPSKVVITRLKLDKDRKKILERKAKSRQVGTRNKGQIQGRNH

SEQ ID NO: 784170 - protein, 93 aa, Homo sapiens; identical to SEQ ID NO: 784160

SEQ ID NO: 784171 - protein, 88 aa, Homo sapiens
SSLERRGRIIITEAGAAKMKFNPFVTSDRSKNRKRHFNAPSHIRRKIMSSPLSKELRQKYNVRSMPIRKDDLKFRLYVDTIKVSKLAK

SEQ ID NO: 784172 - protein, 128 aa, Homo sapiens; identical to SEQ ID NO: 784158

SEQ ID NO: 784173 - protein, 85 aa, Homo sapiens; identical to SEQ ID NO: 784162

SEQ ID NO: 784174 - protein, 122 aa, Homo sapiens; identical to SEQ ID NO: 784156

SEQ ID NO: 784175 - protein, 128 aa, Homo sapiens; identical to SEQ ID NO: 784158

SEQ ID NO: 784176 - protein, 102 aa, Homo sapiens
NQLLPLSCHAWLTFWIFSTEGVSLCCPDWSRTPELRQSTHLGLPKCWDYSHEPLRLALAGTFLVFSSSCISGKDSPSPHYFFCIHFGFIYFSTTLAGESSSS

SEQ ID NO: 784177 - protein, 41 aa, Homo sapiens
LGETSVQLFQQCLSPHMNQRQQPHGLLILQSPAQQFPGQPL

SEQ ID NO: 784178 - protein, 36 aa, Homo sapiens
LLLYEDKLIFFLESHRIITKGQGDPLRSFSHSGSIA

SEQ ID NO: 784179 - protein, 114 aa, Homo sapiens
MEKFLSGQSSQAPSLMTQPAPVLLRPPKKLPASHAHHIPPFESRQEVQDRRHCSFSRPLWFLKKLLLAYSPPQKVIQKYFSHPLYSVFSFTSVDFLKNRSQLRNNATSLSVFLI

SEQ ID NO: 784180 - protein, 103 aa, Homo sapiens
RARSGGSGLSPPRPRPPCPESLPKTSRTKWARLLSGEGSPGPQIAGGGGVDARECEVRVSLGCVQCLQVGILRFQKSGRDGVAYTRWGQSLVSPEAGAGLGAL

SEQ ID NO: 784181 - protein, 204 aa, Homo sapiens
MDPSQFNPTYIPGSPQMLTEENSRDDSGASQISSETLIKNLSNLTINASSESVSPLSEALLRRESVGAAVLREIEDEWLYSRRGVRTLLSVQREKMARLRYMLLGGVRTPEKRTNQTRSLRELRRIKTIQWPLQFCVAKGRGPFGKAELGIKTPDPFSHKFYFWPFFFWLEILLTGLRKLLLSCVRLSPNNFDKEFKEVFFLGS

SEQ ID NO: 784182 - protein, 110 aa, Homo sapiens
EGSSYRTNLPYHPDHTSPDATSLLQVPPLPSTDLEIEAQRGTQVTQGHTWSQWDTKFRFLASSPPPATRWRAGDGGNLNRKPFVPCSHLSRWLDSTFSGQRWGWDGVWAL

SEQ ID NO: 784183 - protein, 24 aa, Homo sapiens
MIMAHCSSLLGSGDPPASTSYSGG

SEQ ID NO: 784184 - protein, 67 aa, Homo sapiens
NTKRRKQHPSPANFPFNSPGIQVPGVGEEKGALVILYHQYNDGVAGFFNFMVDGVLIVNIVRVISLM

SEQ ID NO: 784185 - protein, 115 aa, Homo sapiens
THTHTHTHTHTHTKQLRRTTSACRSSEQPYLKICERSIFWGKIFWFPSLHISPWVLFLPLVSCSQTHEAEKQLGMQNLMCFILCGLEESLVPKIIPWGPLLHRQIKAKRSLLSLK

SEQ ID NO: 784186 - protein, 117 aa, Homo sapiens
SECSSRAVSIFNKEGCLEIVLKYLSRFPTNVDLAISVAYCLQTVTEDNPELLKSFSATALNMLESALLSPVSSMESLLLKTLVAGKIWNLKDIIPCKSQAEIINALLKILSEVLGMD

SEQ ID NO: 784187 - protein, 170 aa, Homo sapiens
SLSGGSDFLVSLPSYAAITINVLEHFLTTLLRCNSNTMYFTQSLQFSVFLSIFTDNCSPSPILEHCHPLKRRTLHSSCCPLSFRTHCSPQKEPQCLNTINLHSHPPPAFPAGGHCTPAWVTEPDAVPKKKKKKKEKKNSIQPSCSMIPTSSVPCFRLNILLIVIELLVSS

SEQ ID NO: 784188 - protein, 105 aa, Homo sapiens
QSPMPCWTWWIWVKAQLFLNQSRSQPLLGSPGPKLCDPLPPSLGEDAQWDHLSQVCLSSWWFVFCLADVTEEGTTTHSGFSRHRKSLPLCTDPAPVRWENLYCTV

SEQ ID NO: 784189 - protein, 70 aa, Homo sapiens
SLRARLESVHCSTVPFGAVVHLALIFPICSLLQRLRPFNASGPFNASGPFNASGPINASGPFNASGPFNA

SEQ ID NO: 784190 - protein, 111 aa, Homo sapiens
TPTRTHTHEHKHPHKHEHTHTHTHTHTRSWWLNLPQGQISKNSGGKSDPSSFQPPWGYSPGGLERERGTSDVGDKALWELAKELGVSLAVPDKEEVPPSDRGWKKGSPQRC

SEQ ID NO: 784191 - protein, 30 aa, Homo sapiens
MSTWRQHALQPEPPGQGPLSRQQLYRRESG

SEQ ID NO: 784192 - protein, 53 aa, Homo sapiens
PSSPQDVAQYWANLLVFMATLLIILLLMVCDEWGIHRILYGIFLKSKFKFLQE

SEQ ID NO: 784193 - protein, 73 aa, Homo sapiens
QCSCERVGGEQKLACTLSSPMRRNAYKNVLSWAGGDGAGQEQDSGLCCWLVLPAGTVFPMPAGERKELLILSL

SEQ ID NO: 784194 - protein, 139 aa, Homo sapiens
HGFSSPLWLLQCPCVFELPVFMRFSLMFLISSSPSSWGLLSVAPALLLVRGCFRPLQDARTVPNTLVSSKNPAASPGAVFCVFMLSFLCPGLCSLGGEQEVCLMPGPTPAPPQPLICILYEPVKAVWDYCNFRKTSVLP

SEQ ID NO: 784195 - protein, 104 aa, Homo sapiens
MLSLGRDHLGEEAKITLLTREPLPRAGTPPPGVHSWPRALSGTRIGVSELVTGPPKPSPGVDFGIVPTARGLVVGVGRGPPPPRVTLRETRARPPDSCGGAGVW

SEQ ID NO: 784196 - protein, 82 aa, Homo sapiens
MNCKARAGYIICPTQCKMKMQELLLKNYSELQNGVNGALNHVWGPSKCLALCDSTGHMPMKLALYGVAILVSDKTDFKPTKI

SEQ ID NO: 784197 - protein, 75 aa, Homo sapiens
WLSGPCSGDTGAYTESSQGNPQRRVAEFVYLSVHTLLLAPLHLPPHLLPLYPFPEASSASAWHTLSLLLSVPFSL

SEQ ID NO: 784198 - protein, 132 aa, Homo sapiens
SESEVWVEGQRPISGGCPQQGVIYGTEEPRPGEPGPPLHTAWPQLRQWPRAAGLVPRQGSGHGLRNGARSRGLPLNSLVHTHMLCLPQGAAPRGPAVLPVEESSPSPRGKAGSAGGTGFLGPGALICRPSLA

SEQ ID NO: 784199 - protein, 88 aa, Homo sapiens
PAFLTVHAMNVVVSLAACTHVSQGEVNRRLLGQQERTSSPLPENARLLSRLCCCLVPQQEMRTPARPMQGSESDLAIFTTLWGTELDL

SEQ ID NO: 784200 - protein, 158 aa, Homo sapiens
ESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHAR

SEQ ID NO: 784201 - protein, 53 aa, Homo sapiens
LIYDFRTQIIILPTPIPGRPSPGSVDMPGSVEVRALTHHSPHIPARLLAYMSQ

SEQ ID NO: 784202 - protein, 126 aa, Homo sapiens [sequence omitted]

SEQ ID NO: 784203 - protein, 126 aa, Homo sapiens [sequence omitted]

SEQ ID NO: 784204 - protein, 282 aa, Homo sapiens
PATRGPSPPGDSADSRTRPARQTTNARRPSAESRTAAPLCTWPPPPRRPIGRRPSLVPPKWTPPPPRGTPLAGVPAPANPAPPPRRPIGPAARRQSRGRPGATSAQRTGCRVMRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 784205 - protein, 230 aa, Homo sapiens
PATRGPSPPGDSADSRTRPARQTTNARRPSAESRTAAPLCTWPPPPRRPIGRRPSLVPPKWTPPPPRGTPLAGVPAPANPAPPPRRPIGPAARRQSRGRPGATSAQRTGCRVMRRRLWLGLAWLLLARAPDAAGTPSASRGPRSYPHLEGDVRWRRLFSSTHFFLRVDPGGRVQGTRWRHGQDSECGAAGAWGGEAAGDGNAAAVFTVTCARGGVPEAPLCSLGLSFRGL

SEQ ID NO: 784206 - protein, 50 aa, Homo sapiens
MAELGCPILQPSCWVHTRSQGNNATATTARHNSWTVLHAPSSFPSVFSRL

SEQ ID NO: 784207 - protein, 115 aa, Homo sapiens
MIPSRTKHHLPKTASADSFLSNLQQPILPGTSSRHPHFLSHTPHSVHQEILLTQLPNKLYPRLTLCLISTASPLVCATGLISTRLMSWQSDLITRMSLLCSKPSKDSHFRVKHSV

SEQ ID NO: 784208 - protein, 106 aa, Homo sapiens
LWPGPAESPSPEEPSFFACCRGGSVGTVAAGSWRPKEGRSELREGSWPGTGVSELYRIQKVPGVLQPSEEFTEWWATQQPGASAVGVGRSGSLSCILWAQQTLKGW

SEQ ID NO: 784209 - protein, 43 aa, Homo sapiens
SCTIYLFAFMEHKRIISNSVLDCLIHLDTCRLSVESIYFFQSS

SEQ ID NO: 784210 - protein, 30 aa, Homo sapiens
MDLNCRCRQPVEFDKRFLAGRAEHSWSADE

SEQ ID NO: 784211 - protein, 150 aa, Homo sapiens
MLLSSRWAESSPVPWSYTGVKTATTDRRVSSSHLGMRELESLCPIPADREWGSHPSCSEVWPWPLTGRFIKLRGWGPGVTCHQTASGWTGGCPGQHWSTWKTTEKVKIAQWRLGAVAHACNPSTSGGQGGQITRLADHEVRRSRPSWLTR

SEQ ID NO: 784212 - protein, 37 aa, Homo sapiens
MRSWICGLSEVRMPFPALAGVGQCRHLLLRLFPFHST

SEQ ID NO: 784213 - protein, 135 aa, Homo sapiens
DTVIHLPDHFSRLKDLSPCSRNAAFRQPSTVSPSLVIAWMKRTASTKVTFPPTTAANHCPSYKKVRTPDILIVPIHGKSEGPSQFEIFVGLFKDSIENWSQPILFLCPILLSSSPFPSTGVDQTSTPYLHAYLHP

SEQ ID NO: 784214 - protein, 96 aa, Homo sapiens
QYQAAVKSGRRTRLGKATTVELNSHREKNSEAMDAWKWGRAWEKTSEKNSEAMDAWKWGRAWEKTSEVWAGVSGLCLGKWMWRRSNEASVGLEVGA

SEQ ID NO: 784215 - protein, 33 aa, Homo sapiens
ATHSSGYSSLQRLLTPVATPHSSGYSSLQRLLT

SEQ ID NO: 784216 - protein, 42 aa, Homo sapiens
VCARMCVCAYVCPEATDPVQVYLEISSVAHKGLRGHYCAGEI

SEQ ID NO: 784217 - protein, 61 aa, Homo sapiens
MRVVHYGARLRSAVWEAGGVWLREWSLPKGTWLMDGGPTPEKKPLTCDLFSQKPSLCTLAL

SEQ ID NO: 784218 - protein, 108 aa, Homo sapiens
HSCLACFYGLSAFHCEAEELLDFLLLGTPSCPVGGPLCDPSACMPTCNVPDITCPCLCTLKSAWTPPSTAPRAQLSSVALSSCSPLLLNTPQLLLPPDSAALARRCWG

SEQ ID NO: 784219 - protein, 93 aa, Homo sapiens
GEDASYPPGGTGLCFQNQITISLSLACNQLQELFGSWPGSETESLKEGDIKRDQDNFSCTMKHNPLLSQTTSFSLGPDGRLLRGYDQSAYDGK

SEQ ID NO: 784220 - protein, 353 aa, Homo sapiens
MPSPVGLLRALPLPWPQFLACTLRRLAGPRESTGPSQKPPPLCSVPCRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQRQTIELIPLTEVHYWYQGKTYVYYIYGTDHQVYAVDYPERYCCGCTIV

SEQ ID NO: 784221 - protein, 315 aa, Homo sapiens
MPSPVGLLRALPLPWPQFLACTLRRLAGPRESTGPSQKPPPLCSVPCRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQVSQGGGAIWL

SEQ ID NO: 784222 - protein, 230 aa, Homo sapiens
WHHLKYNSNHEAFVHIDNTPIVVWWTSVLRPRVLWRPPQSSWRDCPAMTGFFKGAEDRYSSHLWRPQGGPRSKGPGPRSWNTGRTLLPPGSHLWPLQPTVSLVLPSMDLKTDGPLCVPGLEDAGDTSVQNCGLMALRAAMEKCMKMQGEEGGFFPLGGVGARKTSVRGWHGLREGTSRRRGRHAERGPRLGSLSVVPPTVLRVSLHGRCHQPWASAWLGSSHHVASSSSG

SEQ ID NO: 784223 - protein, 106 aa, Homo sapiens
GSWDYCHVPPHPVNFVFLVETGFLHVGQAGLELPTSGDPPASASQNAGITGVSHRARPSFPISYYALSLPEGISVWGYSQGSFDKYSLSCISLEWGHFLQGLQVKK

SEQ ID NO: 784224 - protein, 70 aa, Homo sapiens
SVCGGRFHPQRMIISRHLPSVSSLPFHPQLHPQQMIISRHLPSVCGERLRGPLPPSADDNLKTLSERQLT

SEQ ID NO: 784225 - protein, 125 aa, Homo sapiens
PSKTPSVKDLSLPLYFSCLWASLNGELRDSKDCVFVLQITIHAKHCSVQNLLFCILTSLSRCLSGITDGELFEHMDFVLFIFIAPVLNRLSHRRCSRACRTIEVVQPADRGAKCPHGPPCSFHSM

SEQ ID NO: 784226 - protein, 89 aa, Homo sapiens
GSTCRRGVAGSCGHPSTLNISRNPQTVSTWPHHSDAWQTSPKEELSPRGFLALPRKEFKVEPEVEGNSFTSEVGLQLWLLPQGRASTDS

SEQ ID NO: 784227 - protein, 77 aa, Homo sapiens
GWWSCDSRTRLTVLVRGPFGGWHSQMHCWAPAPQCVLAQEEPKRLESWALGCCPTLRNGPFCHRASWLQHPRGLWEP

SEQ ID NO: 784228 - protein, 140 aa, Homo sapiens
QERDEAVKQLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVCIS

SEQ ID NO: 784229 - protein, 124 aa, Homo sapiens
HRVGQDTPHHLLGSPAAASGHRIFTQEWEGFRLSLVVLQAPSSALFSADMLSDLYSISPSVVPASSEFKILAPCMWSPCVLLSRLGISAEPFLFLGTPPFEDEPTMVDISPFCLRRTDCSFPSS

SEQ ID NO: 784230 - protein, 157 aa, Homo sapiens
VSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTG

SEQ ID NO: 784231 - protein, 34 aa, Homo sapiens
QDLDSGVSGAETETLFGSQIRHRISVRVWPRLVN

SEQ ID NO: 784232 - protein, 215 aa, Homo sapiens
MVLLTMIARVADGLPLAASMQEDEQSGRDLQQYQSQAKQLFRKLNEQSPTRCTLEAGAMTFHYIIEQGVCYLVLCEAAFPKKLAFAYLEDLHSEFDEQHGKKVPTVSRPYSFIEFDTFIQKTKKLYIDSRARRNLGSINTELQDVQRIMVANIEEVLQRGEALSALDSKANNLSSLSKKYRQDAKYLNMRSTYAKLAAVAVFFIMLIVYVRFWWL

SEQ ID NO: 784233 - protein, 215 aa, Homo sapiens; identical to SEQ ID NO: 784232

SEQ ID NO: 784234 - protein, 182 aa, Homo sapiens
MVLLTMIARVADGLPLAASMQEDEQSGRDLQQYQSQAKQLFRKLNEQSPTRCTLEAGAMTFHYIIEQGVCYLVLCEAAFPKKLAFAYLEDLHSEFDEQHGKKVPTVSRPYSFIEFDTFIQKTKKLYIDSRARRNLGSINTELQDVQRIMVANIEEVLQRGEALSALDSKANNLSPSFYRINY

SEQ ID NO: 784235 - protein, 76 aa, Homo sapiens
IRGRVDTAARRRQGGSEDGAKGLPGQCWIPVVCEDGVANNDRPSGGRAPAGRLDAGGRTGGLANCGPFVTLILKAN

SEQ ID NO: 784236 - protein, 103 aa, Homo sapiens
TPSSGFRDTSAPRLRGVGGGSDSLRSPAPPSPDPLAARGVQGCCPGKEARRACSRREGWGGRGRRKTKGCEALNSKRCFESQALGFERRWEDGGRAIPIRNAI

SEQ ID NO: 784237 - protein, 96 aa, Homo sapiens
FWGLCKWNKRPWPLSGPAAVGSLWRTTPQSPGSGMHTLGPALSTGPWGLVCSAGDGMHFEEMPLTPGLPYRSVQIAPGTYPENSAVLFTLWRHLSP

SEQ ID NO: 784238 - protein, 87 aa, Homo sapiens
MVPTPRHVMRMNGVNVYKEFRAGPGCEVHSHWAIFSSRTRGVRTDLGTFMDPTQATVRASLCPPALAQYSQGHPQGHVHVLVHLRPL

SEQ ID NO: 784239 - protein, 97 aa, Homo sapiens
MSPTMSPLAQLCPLCPALRLLSAVTTIIPPHVVLCPRPACNLFPSSGRSQPLLHASFLGSLWYLCVHRLLASKSAVPGALSHPVTIASDSKDTAPWG

SEQ ID NO: 784240 - protein, 48 aa, Homo sapiens
SRVKPIPSPAGQVGGLRATAGVQAAFGHLVPQPWVCLWGADPNGNSFQ

SEQ ID NO: 784241 - protein, 126 aa, Homo sapiens
MRRKLLKTPANLLVSCCFELPPTGQTVGAFDLESEPVTLPKIAGIHAKDDPISPKDILRSSMLTADSFLLSHPLLFASSKWYLQMVLYQKRFLQSNQPWLNAIFRHSKFQRILENGLRNPEYFLGS

SEQ ID NO: 784242 - protein, 69 aa, Homo sapiens
TGVILHQYQQHGRDKDKGHLWALTAPCLNCHGRKPPSSKLGAAVVPILQVGTSKVTCPRTEQMRYFGRA

SEQ ID NO: 784243 - protein, 57 aa, Homo sapiens
MAAAIGLASENGLPGKFTQPDLKQLLRGRGAAPGVLAGKQLAAVREPLASRVLTEEC

SEQ ID NO: 784244 - protein, 107 aa, Homo sapiens
TVQGRNFPQAEASAGTQQTHAALIPSPRGLPRLGLLQVLSTPAQLFRLLGYSFCSFSFSLSSQSVQPTFFFFFLVETESCSVTQAAVLEGCGTISAHRNLRLMSSSN

SEQ ID NO: 784245 - protein, 113 aa, Homo sapiens
MRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEVRTMYHIVF

SEQ ID NO: 784246 - protein, 272 aa, Homo sapiens
MDESSILRRRGLQKELSLPRRGSLIDSQKWNCLVKRCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEVRTMYHIVF

SEQ ID NO: 784247 - protein, 84 aa, Homo sapiens
CRKKAIPPVLLLPTLGKTSFRKERCQRGRTHQQDCQRPDDHSPSIPQPLRPTAQAPEMHSFNLQSKNPPKPTISSTIGLGNGGF

SEQ ID NO: 784248 - protein, 281 aa, Homo sapiens
DVTGLADRTPGAGAREVLSRPSGLCRIVAGLPGRGRVLAAAARSRVPAAAAAAMVSPVTVVKSEGPKLVPFFKATCVYFVLWLPSSSPSWVSTLIKCLPIFCLWLFLLAHGLGFLLAHPSATRIFVGLVFSAVGDAFLIWQDQGYFVHGLLMFAVTHMFYASAFGMQPLALRTGLVMAALSGLCYALLYPCLSGAFTYLVGVYVALIGFMGWRAMAGLRLAGADWRWTELAAGSGALFFIISDLTIALNKFCFPVPYSRALIMSTYYVAQMLVALSAVESR

SEQ ID NO: 784249 - protein, 105 aa, Homo sapiens
MYLSPLSIQLNHISKMSAFFLNITHLCLRTTASRIANSDKRPCLNCLLLSSLHQLSNLVGLSPSSCPSPDFILHTCQVNRPEHPYSSPYSLKAGPSIRRLRYQHL

SEQ ID NO: 784250 - protein, 109 aa, Homo sapiens
MRPASSSARCPVRHLPPCPLTVPIWGPAAHHPWRPAVTPMDAMGAATCWPAPLSRSCDHCPSPARLSPHAQPAHLSRPGLFLEVATRPRPGPLPKKRGSALPHSPLQSQ

SEQ ID NO: 784251 - protein, 163 aa, Homo sapiens
VEGEERDCRIFLQLNFSFLFKAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSESLTQ

SEQ ID NO: 784252 - protein, 56 aa, Homo sapiens
MLTCVDMRVHTNTWTGGYTHVNTDSGRTHTRVGLTLTLGCAVCFQGLCLTVSLSSC

SEQ ID NO: 784253 - protein, 30 aa, Homo sapiens
MKVEKGAVGEGSRDQGYKEKGSVHWQLDRS

SEQ ID NO: 784254 - protein, 36 aa, Homo sapiens
AHPFNDYTFSPLISALIQPTPSMTIPSLSSVPRFCF

SEQ ID NO: 784255 - protein, 155 aa, Homo sapiens
KQPTTVVLTLKTVPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTNPYTYYMESGPR

SEQ ID NO: 784256 - protein, 101 aa, Homo sapiens
SLTTKPRVRRQAVCLWISFLPFSFYFFLWRQKLGIRRYEGWSPPLLEEGRNSHLSSPLEASSNSIKELPAFHRHQSRKNLPFLRWKIVKLQKKGVVLQNKL

SEQ ID NO: 784257 - protein, 140 aa, Homo sapiens
FQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSTKCYHLHHGRHHNFQINT

SEQ ID NO: 784258 - protein, 387 aa, Homo sapiens
MAAVILPSTAAPSSLFPASQQKGHTQGGELVNELLTSWLRGLVTFEDVAVEFTQEEWALLDPAQRTLYRDVMLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTK

SEQ ID NO: 784259 - protein, 387 aa, Homo sapiens; identical to SEQ ID NO: 784258

SEQ ID NO: 784260 - protein, 316 aa, Homo sapiens
MLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTK

SEQ ID NO: 784261 - protein, 78 aa, Homo sapiens
HVRTHTGEKPYECNECGKSFSSSFSLTVHKRIHTGEKPYECSDCGKAFNNLSAVKKHLRTHTGEKPYECNHCGKSFTK

SEQ ID NO: 784262 - protein, 387 aa, Homo sapiens; identical to SEQ ID NO: 784258

SEQ ID NO: 784263 - protein, 387 aa, Homo sapiens; identical to SEQ ID NO: 784258

SEQ ID NO: 784264 - protein, 139 aa, Homo sapiens [sequence omitted]

SEQ ID NO: 784265 - protein, 115 aa, Homo sapiens
MTKKRRNNGRAKKGRGHVQPIRCTNCARCVPKDKAIKKFVIRNIVEAAAVRDISEVSVFDAYVLPKLYVKLHYCVSCAIHSKVVRNRSREARKDRTPPPRFRPAGAAPRPPPKPM

SEQ ID NO: 784266 - protein, 92 aa, Homo sapiens
MAKCASQGKVMFFFFQCQGLAVVSGGTRPPDMGLPGAGRVTVGLPGRWLSHGGSCCTDGPGVSGIQDGAARFLSSCDFHPGPRTLPSVCTSL

SEQ ID NO: 784267 - protein, 49 aa, Homo sapiens
TKAQWGLPGQQSWSLQDKGGPSPPRPLPYGGHREAPLQSALILPMHPLI

SEQ ID NO: 784268 - protein, 92 aa, Homo sapiens
VKRDGLRETAGMLTRTSVSNQQGGCLKMTVWKQVGVNRHSTVLQATHTETQGSRPGHTLGRTFHLTFLSSDLCSGSGAWLVRAAGFSCDALG

SEQ ID NO: 784269 - protein, 94 aa, Homo sapiens
IVIAVIPMMYNLVELERFSYSANNPLKSYSWQLIYIVRFIQLALFIFPRVLNSNLLCTGRMKDLEGRGHIMSKGLDSVSGNLLLIPVLLLFNPS

SEQ ID NO: 784270 - protein, 580 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQENTYKSTWRNPQHFQQDVRMTLGYVGKAQWEEDNQLKVKLGLKKNCSS

SEQ ID NO: 784271 - protein, 619 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYLHDQKRKEQQKDKQTQNDLVTGANLMDIIRKHDKSNSQK

SEQ ID NO: 784272 - protein, 567 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQLNIIWVVPFSGININASLIALLYSLLTTINMKFTP

SEQ ID NO: 784273 - protein, 389 aa, Homo sapiens
MQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEADTMLKMGFQQQVLDILENIPNDCQTILVSATIPTSIEQLASQLLHNPVRIITGEKNLPCANVRQIILWVEDPAKKKKLFEILNDKKLFKPPVLVFVDCKLGADLLSEAVQKITGLKSISIHSEKSQIERKNILKGLLEGDYEVVVSTGVLGRGLDLISVRLVVNFDMPSSMDEYVHQIGRVGRLGQNGTAITFINNNSKRLFWDIAKRVKPTGSILPPQLLNSPYLHDQKRKEQQKDKQTQNDLVTGANLMDIIRKHDKSNSQK

SEQ ID NO: 784274 - protein, 232 aa, Homo sapiens
FLGPTGRSAPPFYTHTSHFLRVPGPRAALLRSFRTVQRLFHQSQPIRLRKFCPRGFPYVPLRPELAQPGPVPRFTTSPELGGGVENARSLPAPLLLPPSLPSHCRLPAELRPRGGPASPPPGKRAAAPSQNPGKWILLYAPLRSAPHHQPRAAVLTSGSGLVGRKPGLEPGRGRRPERERERTRPQSCAGERAPEAWAPGRPGAPSPGPGALGRGGRTGAPARPSSHPYSSP

SEQ ID NO: 784275 - protein, 619 aa, Homo sapiens; identical to SEQ ID NO: 784271

SEQ ID NO: 784276 - protein, 388 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTAAFLLPVIMRALFESKTPSALILTPTRELAIQIERQAKELMSGLPRMKTVLLVGGLPLPPQLYRLQQHVKVIIATPGRLLDIIKQSSVELCGVKIVVVDEVSKGSKTGPYFSILRATSEPRVATVFPRGSRSAG

SEQ ID NO: 784277 - protein, 30 aa, Homo sapiens
APSPITTPSPQTLGAGSRPGRKRPERGKPP

SEQ ID NO: 784278 - protein, 43 aa, Homo sapiens
AGVVLEKATFGQENRDNYSHFRATISRLQNGTFAGEPSSFTPY

SEQ ID NO: 784279 - protein, 127 aa, Homo sapiens
RGRYGEVMPVYRRDSHRDVQAGSHDYPGEGIYLLKFDNSYSLLRNKTLYFHIYYTQLKDCWDRGRLYLLAEAGCQLVPLVWDRQEPKVHGGLLSLTPCLACLTVGPRSFFPFLASAGGGVVPLFCSP

SEQ ID NO: 784280 - protein, 118 aa, Homo sapiens
LIVILNSTDLSFLFTLATLKQSHCQHYGFPKHSSLNSSTSKNHGFPFKFPFHELNTFFFSWPISQSYSLSPNAGFVCLTATMGGCSNVVMKEKRMLRLLSVTLKAMETQVMIFFSYIE

SEQ ID NO: 784281 - protein, 160 aa, Homo sapiens
LEQSMREEALLKVQLTQLKESFQQVQLERDEYSEHLKGERARWQQRMRKMSQEICTLKKEKQQDMRRVEKLERSLSKLKNQMAEPLPPEPPAVPSEVELQHLRKELERVAGELQAQVKKNQRISLLNQRQEERIQEQEERLRKQEERIQEQHKSLQQLAK

SEQ ID NO: 784282 - protein, 51 aa, Homo sapiens
TEDVLLSGPLGAVLMSITQHFTTHVLPQRAGLPSELFSTGWVRWLTPVIPA

SEQ ID NO: 784283 - protein, 38 aa, Homo sapiens
MCQHKATPPWTPQHASTRPRLRGHRSMPAQGHASVDTA

SEQ ID NO: 784284 - protein, 151 aa, Homo sapiens
LAQSTAGRLHERWPFEEAEWPAPCLLSRSSSVPPGKPRGVANTRLLFQPNPALFPWEAQESGPAPACYCYPGPALFPRKLRGVAGTRLLLLSWPSFVSQEAKESSLARACYCYPSPALFPRKLRGVAGTRLLSQPSSVSLGSRGKWPAPTC

SEQ ID NO: 784285 - protein, 108 aa, Homo sapiens
TILPQARAWLSPSSPSLPKCHLSPRPSTTRFNTATGWLCLTLPARPYLTAFFFPQRTSPPTVLHGFLIFIVISFYRICKLQQGRHLCPFCSMKDYKSLEQRQTHRGAQ

SEQ ID NO: 784286 - protein, 145 aa, Homo sapiens
SESQAGLPLKPLHRSRLLREVMLLFALLLAMELPLVAASATMRAQWTYSLRCHDCAVINDFNCPNIRVCPYHIRRCMTISIQLSSGDRAAVCPGPHPTFFQPGAWIPTQVTDSKHQPLPAHLTRRHPLHGPGNILPSAINRPTLC

SEQ ID NO: 784287 - protein, 40 aa, Homo sapiens
FLAAQLSYPQQMELLTPTSTGRPGFLGTREELPYDLVPEP

SEQ ID NO: 784288 - protein, 35 aa, Homo sapiens
KFYPHNSNFWYHVGGHAEPSRNLILKPKSHVQILP

SEQ ID NO: 784289 - protein, 51 aa, Homo sapiens
MVSVYFRVSVESLICFCVSGFPAFIFQLHSIASLLSWDLKRHVGMETAALG

SEQ ID NO: 784290 - protein, 78 aa, Homo sapiens
GAFHSKWREVNHTGRTVGEVGTGQATFQRVMRALGVPTMSPVSSSAPHESFTICRRLSMKVLYVLDTQGDTGCPHAYC

SEQ ID NO: 784291 - protein, 101 aa, Homo sapiens
MVPGARLPLCKFPRGRSTLQRGLPGLGLGRLGPRAWKRAWHTVGLLKVLEQMGDRPADCRSWHPRAPSCPARLPGPGAGAARAGGLAVLLPPPGCQNFQKM

SEQ ID NO: 784292 - protein, 91 aa, Homo sapiens
QGEERDIIIWGLMQEYHHWRSTKQVDPGRRIICSLAKGFWFSQVTQSSRKLRGREEAFRTSHLIGNLYETGTRADGPSPFSLPMSRHCGRL

SEQ ID NO: 784293 - protein, 168 aa, Homo sapiens
GAAPGCQMLTWDCGRLLQAVRCPPGGVGAAPRCQMLTWGCGRCSRLSDAHLGVWALLQAVRCSPGGVGAAPGSQMLTWGCGCCSRLSDAPPGGVGCCSRMSDAPLEVWGAAPGCQMLTGGVGCCSRMSDAPLEVWGAAPGCQMLTWGCGCCSRLSDAHLGVWGAVPGC

SEQ ID NO: 784294 - protein, 120 aa, Homo sapiens
VQGVEVGPAPQGEAFSLESCQNWLPGEPHPATAEHCVRLGPTGWCNTDLCSAPHSYVCELRPGGPVQDAENLLVGAPSGDLQGPLMPLARQDGLSAPHEPVEVMVFPGLRLSREAFLTTA

SEQ ID NO: 784295 - protein, 40 aa, Homo sapiens
NTSAWGCGAAGFRPHSPRGLRHFYRVLMPHIIGARALPWP

SEQ ID NO: 784296 - protein, 106 aa, Homo sapiens
MPSHHALLHEAHLDGGEDQVEVNGAVFPKPFVEKPVSAEDHNVYIYYPSSAGGGSQRLFRKIGSRSSVYSPESSVRKTGSYIYEEFMPTDGTDVKVYTSEGLDYAL

SEQ ID NO: 784297 - protein, 102 aa, Homo sapiens
MPSHHALLHEAHLDGGEDQVEVNGAVFPKPFVEKPVSAEDHNVYIYYPSSAGGGSQRLFRKIGSRSSVYSPESSVRKTGSYIYEEFMPTDGTDVKVMVDIGI

SEQ ID NO: 784298 - protein, 101 aa, Homo sapiens
LRQENYLNLRGGGCSEPRSRHCTPAWATELDSVSKKKKKKSDKIDFKTKTVIIDKEYFIMNKVSVPQEAIPVIDMHVPNNRAPKYMKQKLSELKGKNEQLK

SEQ ID NO: 784299 - protein, 111 aa, Homo sapiens
MEKGDPQLCDFLESHFLNQQVKAIKKLGDYLSNLCKSEPQKQAWQSTCLTSSPWAAARKTPEPRWAPQPRCAFPGSGHQAGACMLPFQNVLFNFFPFSVTIIGNKVICSQS

SEQ ID NO: 784300 - protein, 84 aa, Homo sapiens
PKNHRGCSGASAHHPSVHWRPQRCSWLSMGTSLPVCPGSRMEASAGGVGAEGPTLPVLLSSSLEEVGFAPRWPFTPAPSSLHLH

SEQ ID NO: 784301 - protein, 104 aa, Homo sapiens
LNLISVPDTALHDKLMWPCPASAVTRLQTLVPVRNLAVREEMRQWPGWVAAGKGQIFSSAVCKFSSSSSVFSQRPAPLTCHELSLPGKEMLAKATSFLETPVVN

SEQ ID NO: 784302 - protein, 34 aa, Homo sapiens
AGPDEVRARTIRKGTKAPQAAGKIHTDFEKGFIM

SEQ ID NO: 784303 - protein, 101 aa, Homo sapiens
TFFQSKFALNSIHRSSEPPVNAPWTSVGKVWAALFASRAQFNSKASIPFGIILKFKKFFYIHYATQSIMIHVRGHLFIQSSWEIKTLGTKRKTKKSNHHLI

SEQ ID NO: 784304 - protein, 74 aa, Homo sapiens
MRVLEGVLTPLCCGEAFPSFWLPWYPLEPPICCSEAVPAAAGLLQQLEVEERFLGRESSSSDSEFEPWWSNVRH

SEQ ID NO: 784305 - protein, 95 aa, Homo sapiens
AAECVCVCVATCVPSPRAMCTHVPGAVLRHSRSARHWGHVALAELPHSPVPGPLVKAKRARVSHVCPSWVPVCGFCLIGVRPPCVSHITTSWPSV

SEQ ID NO: 784306 - protein, 74 aa, Homo sapiens
GIFYCAAIDQGGTNLEHGESEVPGGNLSGDYQEGIGSEGLKPHSGILAVDEPCNYYGAGWIPKRESIQSEGIRL

SEQ ID NO: 784307 - protein, 109 aa, Homo sapiens [sequence omitted]

SEQ ID NO: 784308 - protein, 144 aa, Homo sapiens
MWNVLEESSSKHQQPRPQDLSSCIGSHLLPIFLSLWVKNWCPAQWEEDITVTITHCYCDRGKDWNCVSSVRRTLIYFSPLRQGLALSPRLECSGAVLAHCSLDLLDSAFCVATGQYEGWERHTHQTPGMISLCRFCGRDMHVSS

SEQ ID NO: 784309 - protein, 55 aa, Homo sapiens
MVVPFIRAIASAEVKRTQDPNTMFRGNSLASKCIDETMKLAGMHYLHVTLKAIEE

SEQ ID NO: 784310 - protein, 180 aa, Homo sapiens
TEAAHPQTLLDLGASPDYKDSRGLTPLYHSALGGGDALCCELLLHDHAQLGITDENGWQEIHQACRFGHVQHLEHLLFYGADMGAQNASGNTALHICALYNQESCARVLLFRGANRDVRNYNSQTAFQVAIIAGNFELAEVIKTHKDSDVVPFRETPSYAKRRRLAGPSGLASPRPLQRS

SEQ ID NO: 784311 - protein, 117 aa, Homo sapiens
MAVNHKVTGACWRWNNDSRVIACFFEIMCICLSSIIMFGLIFIYACRFGHVQHLEHLLFYGADMGAQNASGNTALHICALYNQVRLCVLHMPAPASVHILASSGGVCVCGHTGDPVR

SEQ ID NO: 784312 - protein, 117 aa, Homo sapiens
WSAMAQSWLTATSASCVQVILLLQPPEYWDYRHAPTRPANFVFSVETGCLHVGQAGLKLPTSGDPYASASQSTGITGLSHRTWPTHFYIPRDPLIHPKADVSCICNTTFSSNIWSFF

SEQ ID NO: 784313 - protein, 92 aa, Homo sapiens
AGPALLTVLPASGWAPGLLLRGPRSAWEKGVISLLTVSWERLFLSVKPSPLVNWSRQSRSLVEKVGRVGPVGQMPLLLHFGQAEPLLPSRHP

SEQ ID NO: 784314 - protein, 109 aa, Homo sapiens [sequence omitted]

SEQ ID NO: 784315 - protein, 197 aa, Homo sapiens
MIQQEEIRKLEEEKKQLEGEIIDFYKMKAASEALQTQLSTDTKKDKHLINMDPDSKCYCRSFLKKNLKRNDIKRPIKTCIQKTKPMQTKPMQNSYVLMVGLNIFPKGFWRTKLCTRSQGPPWKLGPRALIQGPTQEFGFSFAWGFGPSVPGGGQVGEQRSPMADAGLRSPGGLPLLRRCWPWLGPTGPPPPLGARGG

SEQ ID NO: 784316 - protein, 127 aa, Homo sapiens
MAVLQKTEGTFLAITRPPAFTQNPPAPGAAVLAWPVAAHSQALPFPSWSDLCVLLLASPAPCSSTALLMARREALGSTEHPRPGQLKNPFVSLVVPGAESLGFHPAQAGLAAPVDRFVCKVLPTPHQ

SEQ ID NO: 784317 - protein, 73 aa, Homo sapiens
LGHLSQGAGQHPHRIQDHSLPGCFLQSLLYFFLGTTEFFLLAVMSFDRYVAVCNPLHYATIMSKRVCVQLVLC

SEQ ID NO: 784318 - protein, 42 aa, Homo sapiens
FSLILYTVPGLKRKARISVQVQSEDPAGIPNPSAAGEKRVPC

SEQ ID NO: 784319 - protein, 111 aa, Homo sapiens
MLMPVMRFPTLDLQVLAGTRYLQVPGSLQESMLEDVPKKPQDWHRASSQSTNFLEVLVGRRVVLKVRTPDYQHQHHLATWKKWRFPSPTSDFQNPNLQNQSPAIYVCKHPD

SEQ ID NO: 784320 - protein, 58 aa, Homo sapiens
PVPTVIQPPLNNPGHHLAPTGGHQGAHQAHSGLGQRAGLEEGTSNPTDRHAPGARGLL

SEQ ID NO: 784321 - protein, 141 aa, Homo sapiens
GPGTCLGAVVPVGMGSQGLRQSSASLWAEGRRTAPFLGPLIRRVWLHQGGTRGTWLAWEGAAGGWGSRGPPSSSGEVVSGIKGSRQGALAGGVDRCAAVGGPPALAPVSSAPSRLPGVRSVYHADHGPGLRGPQWLERKAG

SEQ ID NO: 784322 - protein, 143 aa, Homo sapiens
VNEACSLLPVMSDSIVIPITPVTVSLDILERQPPQREGTGLPTSHSRGWKEGRVRHHQQPPGLQAQASSSCSGCGACCLLRPRLATAQYCTDLSARNPQRQTEPLTQPGLGLGISGLSFLTGPWGTGCRGPPPPRVHSAQHFA

SEQ ID NO: 784323 - protein, 128 aa, Homo sapiens
MPPHLGKFLNFFFSDRVSLIAQAGLKLLGSSDPPASASQNAWTTGMHHRAQPPFWFSNKAFCSPPSNTSPCSSGLSSNRPGPVPWVLSVLRLLVPCTSPKAPTTKRSKDVGPGAVAYTCISQHSGRLR

SEQ ID NO: 784324 - protein, 105 aa, Homo sapiens
MSVSCPHGDSNVAPQIRPDAVGFVCPPCAPCPCLASPGLNRRSSAPSPPDASSEPGGVLRNTPGGRDMRLSAPWPGSRRGSRSGPEGLQAPGAGRGWRRIAADPA

SEQ ID NO: 784325 - protein, 113 aa, Homo sapiens
NWGKFPPWFLQTEDLGSLFILYLQAMSPQLLSFPYIQAQFPYLFFLQILPILGPSFAMKLSLAVLANINPLLLMATLYMPGTVLDTSYPTACLILPTNLGGELPLSQKNKVKF

SEQ ID NO: 784326 - protein, 97 aa, Homo sapiens
MGKVNWIVPTCMDHRQPMRESEIIDFFLGASLKDEVRRIMPVQKQTRDRPAHQGIKAYGGYTGTTMATSVLDVKCSKEVATDHPWGHTSWSKLSNRP

SEQ ID NO: 784327 - protein, 76 aa, Homo sapiens
MLGEWLFPLIQAMHPTLAGKITGVLLEIDNSELLHMLKSPESLHSKVDEAVAVLQAHQAKETAQKAVNSATGVPTV

SEQ ID NO: 784328 - protein, 138 aa, Homo sapiens
MDRIIGLHLTDSNRIGEHRFLPTNGKKSMLKALKLNSNEARLKFPRLLQIIERYPEETLSLMTKEISSVPCWQFISWISHMVALLDKDQAVAVQHSVEEITDNYPQAIVYPFIISTRYSYSFKDTSTGHKNNNALVAR

SEQ ID NO: 784329 - protein, 68 aa, Homo sapiens
MDRIIGLHLTDSNRIGEHRFLPTNGKKSMLKALKLNSNEARLTSREIPVTNGVGTTEKDQERSTDKVS

SEQ ID NO: 784330 - protein, 34 aa, Homo sapiens
MSTLCQCPESGDKSPGILCPVGLIFLSTVKSTTN

SEQ ID NO: 784331 - protein, 68 aa, Homo sapiens
LMNMCRWDQDCSQPMTSLHGLERGLCHRTQGLGSNTFLGIHQGPWIPCVTTLTHFTDEETEAQENNVA

SEQ ID NO: 784332 - protein, 108 aa, Homo sapiens
ELWPKGAPRDRDRVSTPPPPSLPRTAEWSQEKAQLGGSACCKGSVQRRGRPQCGAGRSGVAGVVFTEDSSRRLGGRRGELINLLKVSSYSIFQSRIQKTGQNSFFRTF

SEQ ID NO: 784333 - protein, 70 aa, Homo sapiens
QLLKGVISHGHRISWGENEEGAISQPKFPKVLKNYTPQKVFALHFAEICYVTVEKMCGVIFSLHFSRGGG

SEQ ID NO: 784334 - protein, 32 aa, Homo sapiens
MTLRLHKPFCQTPIRGTQVRQTMTTGPLQNEE

SEQ ID NO: 784335 - protein, 437 aa, Homo sapiens
KALEHKNRMSRMLEDRDLFVMRSELTESVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEANNFLWPFKLSSPRGGMKKKTTHFVEGGDAGNREDQINRLIRRMN

SEQ ID NO: 784336 - protein, 151 aa, Homo sapiens
NGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAA

SEQ ID NO: 784337 - protein, 89 aa, Homo sapiens
RRDHTTDTASSSRMQALPLPPQAAGAAWCFHTDLAKQEGETVMGHGAQEKVHRAQVAGGAIVHAVYAGALLQPLFSLDIRPAFPCPPLK

SEQ ID NO: 784338 - protein, 84 aa, Homo sapiens
QVLPILHPFYLHRPMLAQTEFLSQQPAHWSSCQCFLSLNHLSHPCWIELPKVDITQLPRAIHTFIGSYSLLNIFEILYLMLKIF

SEQ ID NO: 784339 - protein, 177 aa, Homo sapiens
MAEAASGAGGTSLEGERGKRPPPEGEPAAPASGVLDKLFGKRLLQAGRYLVSHKAWMKTVPTENCDVLMTFPDTTDDHTLLWLLNHIRVGIPELIVQVRHHRHTRAYAFFVTATYESLLRGADELGLRKAVKAEFGGGTRGFSCEEDFIYENVESELRFFTSQERQSIIRFWLQNLR

SEQ ID NO: 784340 - protein, 87 aa, Homo sapiens
LDRESKANYSLKIEARDKAESGQQLFSVVTLKVFLDDVNDCSPAFIPSSYSVKVLEDLPVGTVIAWLETHDPDCAILWSMTIMGDLK

SEQ ID NO: 784341 - protein, 221 aa, Homo sapiens
RGREGTGADRKWGKKSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRV

SEQ ID NO: 784342 - protein, 232 aa, Homo sapiens
AAAGAGGRAGEPGRGMGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRV

SEQ ID NO: 784343 - protein, 67 aa, Homo sapiens
GISPEGTTRMSSTRWLELLCEQGNSKYLASFGDEKVNVIKRLNAITLTPTKTWCLGVDPGVALQSAS

SEQ ID NO: 784344 - protein, 145 aa, Homo sapiens
EGSRRLRADKKPPFGKASESFLGINRRTPTPPPEQTWDAVVFAKREGNLSRASGPGMPLQLHFQKGRAFRNGGGHQTIVFGGVSTGQPVTVSRGTSNKRSELPDGNAARSPRAAPPRLGVPQRSSIRSRTPESGAASRTAAAHHP

SEQ ID NO: 784345 - protein, 198 aa, Homo sapiens
MKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTM

SEQ ID NO: 784346 - protein, 278 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKIQCEKLVPDIYLR

SEQ ID NO: 784347 - protein, 278 aa, Homo sapiens; identical to SEQ ID NO: 784346

SEQ ID NO: 784348 - protein, 34 aa, Homo sapiens
MSLLEHNIYIVGTQENIQGFDALVSFPSFFVNIL

SEQ ID NO: 784349 - protein, 249 aa, Homo sapiens
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGGRGRRGRGRGSPHLSGAGDTSISDRKSKVGARQRLEPWLRFSVVCFCFFLLSDAHLSCVSIFQYLSLSLCIWLCFSLPPPPSPPPAPPLLVPPVPSLSRLELVCFSLSLSLLLLLPVFLFLLA

SEQ ID NO: 784350 - protein, 531 aa, Homo sapiens
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGGRGRRGRGRGSPHLSGAGDTSISDRKSKEWEERRRQNIEKMNEEMEKIAEYERNQREGVLEPNPVRNFLDDPRRRSGPLEESERDRREESRRHGRNWGGPDFERVRCGLEHERQGRRAGLGSAGDMTLSMTGRERSEYLRWKQEREKIDQERLQRHRKPTGQWRREWDAEKTDGMFKDGPVPAHEPSHRYDDQAWARPPKPPTFGEFLSQHKAEASSRRRRKSSRPQAKAAPRAYSDHDDRWETKEGAASPAPETPQPTSPETSPKETPMQPPEIPAPAHRPPEDEGEENEGEEDEEWEDISEDEEEEEIEVEEGDEEEPAQDHQAPEAAPTGIPCSEQAHGVPFSPEEPLLEPQAPGTPSSPFSPPSGHQPVSDWGEEVELNSPRTTHLAGALSPGEAWPFESV

SEQ ID NO: 784351 - protein, 531 aa, Homo sapiens; identical to SEQ ID NO: 784350

SEQ ID NO: 784352 - protein, 301 aa, Homo sapiens
GLKRFCLPRASQSAGITGLSHHARPCPTSSVPCLVDRLSLIRFLTLTSPIFLILLLPCSPSCPLTRYLSPRFKDGPVPAHEPSHRYDDQAWARPPKPPTFGEFLSQHKAEASSRRRRKSSRPQAKAAPRAYSDHDDRWETKEGAASPAPETPQPTSPETSPKETPMQPPEIPAPAHRPPEDEGEENEGEEDEEWEDISEDEEEEEIEVEEGDEEEPAQDHQAPEAAPTGIPCSEQAHGVPFSPEEPLLEPQAPGTPSSPFSPPSGHQPVSDWGEEVELNSPRTTHLAGALSPGEAWPFESV

SEQ ID NO: 784353 - protein, 301 aa, Homo sapiens
MAATLDLKSKEEKDAELDKRIEALRRKNEALIRRYQEIEEDRKKAELEGVAVTAPRKGRSVEKENVAVESEKNLGPSRRSPGTPRPPGASKGGRTPPQQGGRAGMGRASRSWEGSPGEQPRGGGAGGRGRRGRGRGSPHLSGAGDTSISDRKSKEWEERRRQNIEKMNEEMEKIAEYERNQREGVLEPNPVRNFLDDPRRRSGPLEESERDRREESRRHGRNWGGPDFERVRCGLEHERQGRRAGLGSAGDMTLSMTGRERSEYLRWKQEREKIDQERLQRHRKPTGQWRREWDAEKTDGM

SEQ ID NO: 784354 - protein, 146 aa, Homo sapiens
FYFIFEKGSALSSRLQCGGMISAHCNLCLPGSSDSPASASRVAGITGARHHNRLIFFVETGFHNVGQTDLELLTSGDPPASASQGAGITSVSHRPRPVEHLKLLKRTLRFHWHEGARTTPGFQASVPSAWHLLIETRNEGLEAETA

SEQ ID NO: 784355 - protein, 586 aa, Homo sapiens
MAATLDLKSKEEKDAELDKRIEALRRKNEALIRRYQEIEEDRKKAELEGVAVTAPRKGRSVEKENVAVESVSSSLGCGTLRMGRGRGLRPGTQEPPAVLHQWVASILAACLPAPVTVFSPSPLFQEKNLGPSRRSPGTPRPPGASKGGRTPPQQGGRAGMGRASRSWEGSPGEQPRGGGAGGRGRRGRGRGSPHLSGAGDTSISDRKSKEWEERRRQNIEKMNEEMEKIAEYERNQREGVLEPNPVRNFLDDPRRRSGPLEESERDRREESRRHGRNWGGPDFERVRCGLEHERQGRRAGLGSAGDMTLSMTGRERSEYLRWKQEREKIDQERLQRHRKPTGQWRREWDAEKTDGMFKDGPVPAHEPSHRYDDQAWARPPKPPTFGEFLSQHKAEASSRRRRKSSRPQAKAAPRAYSDHDDRWETKEGAASPAPETPQPTSPETSPKETPMQPPEIPAPAHRPPEDEGEENEGEEDEEWEDISEDEEEEEIEVEEGDEEEPAQDHQAPEAAPTGIPCSEQAHGVPFSPEEPLLEPQAPGTPSSPFSPPSGHQPVSDWGEEVELNSPRTTHLAGALSPGEAWPFESV

SEQ ID NO: 784356 - protein, 304 aa, Homo sapiens
MAATLDLKSKEEKDAELDKRIEALRRKNEALIRRYQEIEEDRKKAELEGVAVTAPRKGRSVEKENVAVESVSSSLGCGTLRMGRGRGLRPGTQEPPAVLHQWVASILAACLPAPVTVFSPSPLFQEKNLGPSRRSPGTPRPPGASKGGRTPPQQGGRAGMGRASRSWEGSPGEQPRGGGAGGRGRRGRGRGSPHLSGAGDTSISDRKSKVGARQRLEPWLRFSVVCFCFFLLSDAHLSCVSIFQYLSLSLCIWLCFSLPPPPSPPPAPPLLVPPVPSLSRLELVCFSLSLSLLLLLPVFLFLLA

SEQ ID NO: 784357 - protein, 57 aa, Homo sapiens
WSVCVEYGMVDTELLGLTALTARCPWELIRPGGLGSHHLGLTGLRHLPCGQSRCAEM

SEQ ID NO: 784358 - protein, 99 aa, Homo sapiens
PPKPKPAKPKPAKHKPDKPKPAKPKPAKHKPDKLKPDKPKPAKPKPAKHKPDKLKPDKPKPAKHKPDKLKPDKPKPAKLKPAKPKLSLSPTLVGLSFSY

SEQ ID NO: 784359 - protein, 165 aa, Homo sapiens
RPRPRPCGSHPGPARPGRAAVAVAEAGQPEAAVPGRCSPRRRRAPSASPRPPRAPRATRRCPPAPRPAGAPGPGHCPGPSTPQAGLPETRAPRGGPGPLLGARQTASSTPRAAGGPRGSPPAPRSRGPGARGPRRDGRPARTAAGRLDWLRASCASRLKAPEPRH

SEQ ID NO: 784360 - protein, 122 aa, Homo sapiens
MMDGGRGSLNSAYLEGRLETAAVARKPRLGAPGSRPLLWLSDRPGAGPPEEEGARGGAQAAAGRRARAPGIAQPVRRAAAACPRAAVLSARRAADPQAGAKSPAPLAASMGQGLGEGGGGGR

SEQ ID NO: 784361 - protein, 55 aa, Homo sapiens [sequence omitted]

SEQ ID NO: 784362 - protein, 55 aa, Homo sapiens [sequence omitted]

SEQ ID NO: 784363 - protein, 123 aa, Homo sapiens [sequence omitted]

SEQ ID NO: 784364 - protein, 87 aa, Homo sapiens
WAASPGTGPGPSPTGAPEAPRTVATAPTSRKEDQDVSTPEQTFSKYPDVSKGCSDSKENYLQVNLCYWSHSFSVVICSTEFLFSSLP

SEQ ID NO: 784365 - protein, 37 aa, Homo sapiens
PWTTRRMEIPLRKKGKYEHQDVQQEIRNENTAIPTLA

SEQ ID NO: 784366 - protein, 136 aa, Homo sapiens
RSVAVNKGRLKRLGITHILNAAHGTGVYTGPEFYTGLEIQYLGVEVDDFPEVDISQHFRKASEFLDEALLTYRGKVLVSSEMGISRSAVLVVAYLMIFHNMAILEALMTVRKKRAIYPNEGFLKQLRELNEKLMEE

SEQ ID NO: 784367 - protein, 55 aa, Homo sapiens
MGISRSAVLVVAYLMIFHNMAILEALMTVRKKRAIYPNEGFLKQLRELNEKLMEE

SEQ ID NO: 784368 - protein, 146 aa, Homo sapiens [sequence omitted]

SEQ ID NO: 784369 - protein, 128 aa, Homo sapiens [sequence omitted]

SEQ ID NO: 784370 - protein, 109 aa, Homo sapiens
MAEQAELQGRNSSSSTKPWEGLIRIYHSVPRHSGLFPPSGRTHCLKSHLLLFFVLSSGIVIFPVGKIMDNGSRLAWWLTPVISALWEARQVETSLANMVKPCLYSKYKN

SEQ ID NO: 784371 - protein, 149 aa, Homo sapiens
MKIIFFFKQSLTVLPRLECNGTILAHCTLHLLSLSDSLASASQVVGITGTCHHAWLIFAFLVGMGFHQVDQAGLKLLASSDLPASVSQSAGITCMSHHDWPYCENNFDPMDLLKGSPGPLGVPELHLENPCYSLIKSLPIKCDSHFVSV

SEQ ID NO: 784372 - protein, 104 aa, Homo sapiens
HITDPEDLILSVHWVNFHAEHTCVTSTQIKEQNIASPRVPHRAPVVMTPQRGTTAATSKQLGSLLYLIEIRSYSMKPFVPGSRLNMTLVKFSTLFSTVVASSLA

SEQ ID NO: 784373 - protein, 112 aa, Homo sapiens
AGYPLSHLWMARLKECTVTHAHLGFESYRHPPLDAAIGLEPKSTCPSSCTYRYACSPSLKEFELAVAEQRATPLWHTLWWGTRTRELSLFTIMRTGWGNRPQHSFISTWSLV

SEQ ID NO: 784374 - protein, 75 aa, Homo sapiens
GWLGCARQLPGWLETCFPQANQVHTVKVDGGVCSSRKSPGSNYHSLVTLWSLPCFHRSLKLLNPDLCSAEHLFQR

SEQ ID NO: 784375 - protein, 98 aa, Homo sapiens
SSAPRQIGPRRKPKITASRKLLLKVGWGLQNWNSGLGQDKCQPAFSIFIRNPLLTLRCLKSSSLLFNLCSSEKAAVSYLDLGAEALTSHSDSAAAEIL

SEQ ID NO: 784376 - protein, 435 aa, Homo sapiens
MAPFGRNLLKTRHKNRSPTKDMDSEEKEIVVWVCQEEKLVCGLTKRTTSADVIQALLEEHEATFGEKRFLLGKPSDYCIIEKWRGSERVLPPLTRILKLWKAWGDEQPNMQFVLVKADAFLPVPLWRTAEAKLVQNTEKLWELSPANYMKTLPPDKQKRIVRKTFRKLAKIKQDTVSHDRDNMETLVHLIISQDHTIHQQVKRMKELDLEIEKCEAKFHLDRVENDGENYVQDAYLMPSFSEVEQNLDLQYEENQTLEDLSESDGIEQLEERLKYYRILIDKLSAEIEKEVKSVCIDINEDAEGEAASELESSNLESVKCDLEKSMKAGLKIHSHLSGIQKEIKYSDSLLQMKAKEYELLAKEFNSLHISNKDGCQLKENRAKESEVPSSNGEIPPFTQRVFSNYTNDTDSDTGISSNHSQDSETTVGDVVLLST

SEQ ID NO: 784377 - protein, 101 aa, Homo sapiens
LGHEFAASPICRCSMDAQFHLGQYSLSTHYAEVGRYLLSKCVNYKHASFNPRTVFEEWLGRIKHCGFQQWRPHLLMGCFKKKMAFEVGHGGSPCSPSTLGG

SEQ ID NO: 784378 - protein, 104 aa, Homo sapiens
TTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHR

SEQ ID NO: 784379 - protein, 51 aa, Homo sapiens
MGFHSQVEEGNACASERGTLTEETGRSSSPFSSSWAAPHGQLLMGSSSWAA

SEQ ID NO: 784380 - protein, 41 aa, Homo sapiens
WLSPKKLKTEGTGDTQTQGKHLSWLPQHRGRGRTLWKPSGA

SEQ ID NO: 784381 - protein, 95 aa, Homo sapiens
CLALPSEMNPVPQMEMQKSPSSASPTLEAVDRNSYSAIFGSSSQQSSLKDLAHRCLLKCGRNTFVCHKTSAGDWSLEEGGEKRRTSGEIVLLIGV

SEQ ID NO: 784382 - protein, 50 aa, Homo sapiens
MSFKKEMILVGHKDNTFARDNTFARDNTFARDNTFARDNTFARDNTFRAD

SEQ ID NO: 784383 - protein, 83 aa, Homo sapiens
QPGPARHPGTAVEAQHLSEEGPAQPGQETVPALPPLKGLLATPAPVLRQTSLRGQAYPEIVHSSVCPIPALQMFLRFGGRRSS

SEQ ID NO: 784384 - protein, 168 aa, Homo sapiens
SLSLDLSLTLSLGLPLTVSLTVSLAVSLSLSLTLSRYLCFSQRLCLSRCLFLSPSLAISLSLSVSDTLSLFLPSSPPWGFPVSFPSSPSLALSSPFSPSPHKLSPLASSPPSPSQLRLSMPAPSFPVPLPVIVLDPSLSSSLLPPARLSLALTAFSVDAAANSVVVVD

SEQ ID NO: 784385 - protein, 30 aa, Homo sapiens
MFSSLLWGLETTAEHTPSKQWPQEDHEELG

SEQ ID NO: 784386 - protein, 73 aa, Homo sapiens
RAAIMDTSRVQPIKLARVTKVLGRTGSQGQCTQVRVEFMDDTSRSIIRNVKGPVREGDVLTLLESEREARRLR

SEQ ID NO: 784387 - protein, 73 aa, Homo sapiens; identical to SEQ ID NO: 784386

SEQ ID NO: 784388 - protein, 40 aa, Homo sapiens
TEQLYYTPVFIPYLHIKEDQESERVYTFPSSNYLYLQARV

SEQ ID NO: 784389 - protein, 71 aa, Homo sapiens
DLRVASPKTRHLFSKVGSWDQVSRGRKSPFNAVHQQSRIMALSVSLTPSWLNDLSRSFLRASVSSSVKRAS

SEQ ID NO: 784390 - protein, 129 aa, Homo sapiens
MLARMVSISWPRDPPTSASQSAGITGMSHRARPSSAFLTKQCTVYISRQVLELPAGRKKGPPGMSDVKGKFQSWVQCFEWGRVAEVCLELFAEAICLHWWWYHLVYIGVSNLLASLGHIGRRRIVLSHT

SEQ ID NO: 784391 - protein, 82 aa, Homo sapiens
SFSVTPTLAILHGLRESSRKLCDESWGTLIWKKALMTGGANLPRMLFSISWDEDTEFLFHPVNVVNEGIEFPALIFLNRIQK

SEQ ID NO: 784392 - protein, 128 aa, Homo sapiens
AHATATVWSGLASAAALTARALLKRSLACAAAPQRCGWRRLLCSSLGSRGHGGQAHRGAHLRVVRYGTASVFGTPRLVASQIQHVPSGPAPRPGASHPATPCIQTLRQPLHLSPDIAVPGASSAGAGA

SEQ ID NO: 784393 - protein, 104 aa, Homo sapiens
MRATGRHLFSHRYGGYKSKVEGSAGLFALRPLLLDGRDPFWLCPLWPFLYEPVLYLWGLSASKYLFFFFQTVLLLFSRLECNGTISAHCNLCLPSSSDSRASAS

SEQ ID NO: 784394 - protein, 69 aa, Homo sapiens
QCAAAGTEVTWTWTVPVSDAGGQDATPEMISNRAGRRKGEDPGGGLVLGPQVLAEEVGLSAQMALRLAE

SEQ ID NO: 784395 - protein, 114 aa, Homo sapiens
PKVSSLNILVTKCTQRAGRVTWRQGTLGPRVVVFPGGPPVRSEGSRRPPHLPGFPRAFLCQEQLPQDPGIPGPPLPPPCSQEPPARCSDHRKQEPSGPLPEDGFCCQPEVLGLA

SEQ ID NO: 784396 - protein, 117 aa, Homo sapiens
SVRAQPHSCPASGTPSPCLERGEWLGGWGSRSENIPVEGPQAERKPGAEPDANNVFPPTQAGGRLAAPRRLESALTSLLCPYFRPWKNADAAEATGLLPGQPDRGFKFSFLLQENFP

SEQ ID NO: 784397 - protein, 80 aa, Homo sapiens
SCASPGFSPVLLRPQCPLPQWLLLTDLCSQSKRRPIKTHWAVISNSPSLGRERTQVMPERQAFNSHGGLRAWLLKTIARG

SEQ ID NO: 784398 - protein, 67 aa, Homo sapiens
LSAAVTCSSSYLVWYQDSASARLLLSNLLILGLDLSDDAVQVQIAVFANTQSYMDASHVPAGSTSAT

SEQ ID NO: 784399 - protein, 101 aa, Homo sapiens
RTLSGSMHTHTHTHTHILTHTHTRTHRVSLCLTLSLSQSLVPGVGLIVHPFLYEQIASLPHFCCVGLELVCPSWDVLGHISHYPSQATAFALSLNYRLWST

SEQ ID NO: 784400 - protein, 110 aa, Homo sapiens
MTPKLPKGGGELQGVNTRVHKACYEINDCIKQRGYYPPCWPQRYEFDERDDKRECCPQVSPERGWNTEGYTKVARVSEGVRTFDARSGGRELLFLSYRFSSQYGNPNKHI

SEQ ID NO: 784401 - protein, 120 aa, Homo sapiens
TGWKGSFCTETVSTCDPEHDPPHHCSRGATCISLPHGYTCFCPLGTTGIYCEQALSIRHPLSEGIGFPGGFGSLKVEKGKFNSGQASRSRGPFLMLHTLKPNQEFFSPREMVLTRTPCAV

SEQ ID NO: 784402 - protein, 173 aa, Homo sapiens
SPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 784403 - protein, 173 aa, Homo sapiens; identical to SEQ ID NO: 784402

SEQ ID NO: 784404 - protein, 95 aa, Homo sapiens
MEMGDYWSLLSGKVRPGWPLHASPLFRKESERLTLRAVCLVALPLVQEQPPCESQLGTGRVGVAGWRAPQVLGGLELLDGLLLKLLKLGFPLTCV

SEQ ID NO: 784405 - protein, 42 aa, Homo sapiens
RKLDLGGESSNLPRRGKNSEVYQRARDQNQNSKAPTSQKWAN

SEQ ID NO: 784406 - protein, 279 aa, Homo sapiens
MCERSLYRAGYVGSLLNLQSPDSFYFSNLRPNGGQLAALPPISYPRGALPWAATPASCAPAQPAGATAFGGFSQPYLAGSGPLGLQPPTAKDGPEEQAKFYAPEAAAGPEERGRTRPSFAPESSLAPAVAALKAAKYDYAGVGRATPGSTTLLQGAPCAPGFKDDTKGPLNLNMTVQAAGVASCLRPSLPDGKRCPCSPGRPAVGGGPGEARKKRKPYTKQQIAELENEFLVNEFINRQKRKELSNRLNLSDQQVKIWFQNRRMKKKRVVLREQALALY

SEQ ID NO: 784407 - protein, 270 aa, Homo sapiens
MCERSLYRAGYVGSLLNLQSPDSFYFSNLRPNGGQLAALPPISYPRGALPWAATPASCAPAQPAGATAFGGFSQPYLAGSGPLGLQPPTAKDGPEEQAKFYAPEAAAGPEERGRTRPSFAPESSLAPAVAALKAAKYDYAGVGRATPGSTTLLQGAPCAPGFKDDTKGPLNLNMTVQAAGVASCLRPSLPDGLPWGAAPGRARKKRKPYTKQQIAELENEFLVNEFINRQKRKELSNRLNLSDQQVKIWFQNRRMKKKRVVLREQALALY

SEQ ID NO: 784408 - protein, 149 aa, Homo sapiens
MVRPERGWRPWGENLGNQFSNNFVINDSPFSKDQSDLGPCQWPQKKTKPISGESRCTGMALYRNGCIVVGTQHKRKTWDPLFKNYEFQDSNSRALKHTQGTSKHGALCTCLGCMPEASPVSVLPSYPQPQTHQPGIGEYWLSGLQPASS

SEQ ID NO: 784409 - protein, 173 aa, Homo sapiens
HAALRGPRDCVLPPLPSGLQSLLGPVSTSSLVLVPPLTPGLPPATLPGPSPPVPPRRWLQPVLGHQPERGCVPSLALPKPGVCVHLWEWLPEGLGAGVGRGGPCATFQAPAVAGACPSGSHAWASAPLAATCGGAGKPRLICCSNPFQRFSGRVATRVEFSLDAPSHLPPLCA

SEQ ID NO: 784410 - protein, 109 aa, Homo sapiens
MHIPCSAVHIIRISHPTAAGCPARALRQEVGQMQTSAPSLAYFRIPQGSLTSEAAWDPRPHLVCRPRLDRGNSQNSTISPSQPPRSPEWGLRPTCTLICGHAGTQQVQS

SEQ ID NO: 784411 - protein, 72 aa, Homo sapiens
MGSRRRTRQAMPSRTLDPFRIPQSSLDAHPLLSSPHHPYLSSHSRGLPSQGPAQLSPHPRAHLVLLLDDFWV

SEQ ID NO: 784412 - protein, 32 aa, Homo sapiens
MSNCYMPGPVLETDEAPVPMELRSEYVDRVSR

SEQ ID NO: 784413 - protein, 1075 aa, Homo sapiens
IRCNGSAGLLDARRSRDQVRVLSSGLSTVDPMGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 784414 - protein, 736 aa, Homo sapiens
MSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 784415 - protein, 1044 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 784416 - protein, 495 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKQKETSQNGRNKRWIRKQNTRVIRSMIFDVGKTS

SEQ ID NO: 784417 - protein, 280 aa, Homo sapiens
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGVSKFLKT

SEQ ID NO: 784418 - protein, 108 aa, Homo sapiens
SCVPIGHMGFCMKATMSSPLNLVILLEIPPVNFYANNLSPLTPRPKVTRVMNRAIAHLFPLNVVVGAHLQKEAVYVEFQIWLFSLQGGGKDSVSLMFITVGQSLSGEG

SEQ ID NO: 784419 - protein, 103 aa, Homo sapiens [sequence omitted]

SEQ ID NO: 784420 - protein, 80 aa, Homo sapiens
AFGIWSGTEGTVSCPGGARCRAEAAHFSVRQPGRGGLGMAANSGAQGPSDEAAGPNLNSKSTVRGVCVQVHRPGRKAWVC

SEQ ID NO: 784421 - protein, 150 aa, Homo sapiens
MIKTLSKIGIQGAYLKVIEATYDRPTANIILNGEKLKSFPVRNRTRQGCRLSPLLSSIVLEVLARAIRQEKEIKDIQISKEEVKLSLSADNMIVYLENSKDYSGKLQELIKEFSKVFRYKINVHKSVTLLYTNSDQLENQIKNSTHFTIA

SEQ ID NO: 784422 - protein, 159 aa, Homo sapiens
QGGNKGPRLPALKQEPDSLFRPWGPRTLLLATRAGFLQASSTWEGWGGMGETGQPAGNTGASQTIASLWGLVPPQAGPGRSGVGPLGNLGPTVACIPGGCSHASQVTLTGWVPLPQTWVLRAGAPCWSPPARYSQARATARPGGTRGPCRGAEVRAVAG

SEQ ID NO: 784423 - protein, 41 aa, Homo sapiens
MTQCTTTQCTTTQCTTDTVHHDTVHHDTVHHDTVHHDTVHH

SEQ ID NO: 784424 - protein, 85 aa, Homo sapiens
VHRLKMVSFSRLIFMDLEIQDCCLFLARALRRMQRGGGGGGLGGEVERTIIRAGLCVGCLSWQRGTQSHLEPVSRHRLKMDIYVC

SEQ ID NO: 784425 - protein, 96 aa, Homo sapiens
PKPGLSPREGSYPSLVWPCKPLLLVHTCAREFFSWLVRAMNEGHWPVEGSARPGLACLKSSDQRGQWGSCPDHTAGRWSAWLHSLLPTSQLSWDGD

SEQ ID NO: 784426 - protein, 53 aa, Homo sapiens
GLYYDFMDKSFTAAMKQKKVRNLLSSFYESSMTWISGYTLKKENEMQNSFKMQ

SEQ ID NO: 784427 - protein, 159 aa, Homo sapiens
SAYAATVLRMDRELHLKLNSNYCKKSKAWWKLNVMVPDRQPQFALAPTCKRTGLGSGLGKRSKAEESQEEVAGGTRFPHVALGRGVLWRLWEETPRCSPGKPPLGRECPGEEDGPPQGVLCLFPALPAHSQDPHTHLSSLHPEDALIATASLFLVGTES

SEQ ID NO: 784428 - protein, 141 aa, Homo sapiens
MDMVKKACMSEDEREALRSSGACHISDILRGAAFEGKPGTSYCILHPYKEERGTALRHLCVLESACTALEDTSLTPLLGNGKTASFEWGPEKKRALLKIWIGRWASLLHRSNGLPGGLFGVGRTLYGISGKLQRKSCSTLS

SEQ ID NO: 784429 - protein, 129 aa, Homo sapiens
SCPSCLTALSVCYLLNCLPLAAESVGAASPTLSTRGLAERGITWTEAERASSWHGFSSGQQHRGLWKLVLLASAWRRGWKGPGRKSSVSILRWGKCKAHWGIGGSHVRPLHLPPPGPALDSDCPRIGNS

SEQ ID NO: 784430 - protein, 129 aa, Homo sapiens
PLGSSSHQSRGMDGVQPTPQAQDCLSTPQPQPDSHTAGNKAERNWRLLLGARHADVICVADPDWRKQTEKGRGRPTPQLQPPWFMVASIPFALRVIDQRFGSQCIPDDATNHERGHSTASRATVYITHR

SEQ ID NO: 784431 - protein, 171 aa, Homo sapiens
EGIALGTRGGLQACSAFCNSAGETPGKKLARANAEAGKRVTVSCGKHKRERGQRRSKRNKGLEDRSLLPCDLGMIGTAARPSVTMGKLPCWGKAPGSQDELNVIRFRSREGLDRRRSIALHKVRAACLFGDTLSPLMASSRLWILGTCDVAGLYLCEFDLWVDLWVFLCLT

SEQ ID NO: 784432 - protein, 72 aa, Homo sapiens
LELAAVQLVIGWCHRRRSVNGESPATRPTHTKAVTSSLGELGSPQGMRFIAKGPREVLNNEKSKDKGTEGLK

SEQ ID NO: 784433 - protein, 94 aa, Homo sapiens
RIQCFYMSQIGIDRSTRETLVLAFTDKHRHTTQNYTHFLHYRERRLNRTGEALGEDCQHEQLSRFTPAVPRRASQRRDNLDTAKRNPAKLQNTS

SEQ ID NO: 784434 - protein, 120 aa, Homo sapiens
MRPGIPQTETAAHCNTASDVVDWRLQQHRRLGPHLRRGDQCLQLLDLHRPSSSSCRQLALACASSFCEEPDIARDLRSHRQCVGCNTVGFGWGHGKPHGEPAPWLTRSVHDEWGWLMGNT

SEQ ID NO: 784435 - protein, 221 aa, Homo sapiens
MEAVLIGNEKLHDVGNKAKNNATNNTTGCGDRTQHDDKDLRRTTRVGTTWHPSRDTANTVGQGDPQEDNRGDQTDAWRMLNQSKRPGRYTLRSWTQPREGREAKKGQQTEDRGGIQYARTGDGSKQGQAETGEKSSEEGEQDRKLRTEKQKRGQVQEAKTKTQNETREETKHRKKESKNERESRLGRKEEEQAKRDNKDSKGQPKDSRNNTKRRNRKSKET

SEQ ID NO: 784436 - protein, 115 aa, Homo sapiens
ACTPQLVLPFSNDSRFLLSSLHLPPLSITCSALIRIQFSEKWNSRITDLRKQVEELSERKYSVSKLEKSCNSLFMSIYTMELLFHHGGTVDKPRAAGESCHPYTSFLVRYFVVSV

SEQ ID NO: 784437 - protein, 264 aa, Homo sapiens [sequence omitted]

SEQ ID NO: 784438 - protein, 136 aa, Homo sapiens
ESGRCMEPGDSWRRRGSTWKGHSLVSLHIANVSHHIPGSLPDLLPGQPRNPRATWGWACSSCSLRSLALLALHLLEEGAGTSPQGPVSAFSCLNSMEKAWRSMGKTPFILGWSGLEARSSFLNPAALPFSLPCTQG

SEQ ID NO: 784439 - protein, 40 aa, Homo sapiens
NTGTLAGGIPAVSCVCTCVHVASPAYSHPADLMRTHPRAA

SEQ ID NO: 784440 - protein, 205 aa, Homo sapiens
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 784441 - protein, 206 aa, Homo sapiens
AVRRVLDPTSGPVGLPPARALAQLAGHGSEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 784442 - protein, 196 aa, Homo sapiens
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGGINPVDNFLTFKKIKGPSPYYYCLAFI

SEQ ID NO: 784443 - protein, 205 aa, Homo sapiens
MEGNGPAAVHYQPASPPRDACVYSSCYCEENIWKLCEYIKNHDQYPLEECYAVFISNERKMIPIWKQQARPGDGPVIWDYHVVLLHVSSGGQSFIYDLDTVLPFPCLFDTYVEDAIKSDDDIHPQFRRKFRVICADSYLKNFASDRSHMKDSSGNWREPPPPYPCIETGDSKMNLNDFISMDPKVGWGAVYTLSEFTHRFGSKNC

SEQ ID NO: 784444 - protein, 240 aa, Homo sapiens
AVRRVLDPTSGPVGLPPARALAQLAGHGSEENIWKLCEYIKNHDQYPLEECYAVFISNERKMIPIWKQQARPGDGPVIWADPQKPPLLLVWSRSLQTFSSAFTCMQMYFCNAHDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 784445 - protein, 187 aa, Homo sapiens
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKMKW

SEQ ID NO: 784446 - protein, 221 aa, Homo sapiens
LSPRAPPTPRREPTRATTSPPFPTSGPVGLPPARALAQLAGHGSEENIWKLCEYIKNHDQYPLEECYAVFISNERKMIPIWKQQARPGDGPVIWDYHVVLLHVSSGGQSFIYDLDTVLPFPCLFDTYVEDAIKSDDDIHPQFRRKFRVICADSYLKNFASDRSHMKDSSGNWREPPPPYPCIETGDSKMNLNDFISMDPKVGWGAVYTLSEFTHRFGSKNC

SEQ ID NO: 784447 - protein, 205 aa, Homo sapiens; identical to SEQ ID NO: 784440

SEQ ID NO: 784448 - protein, 240 aa, Homo sapiens; identical to SEQ ID NO: 784444

SEQ ID NO: 784449 - protein, 108 aa, Homo sapiens
MEGNGPAAVHYQPASPPRDACVYSSCYCEENIWKLCEYIKNHDQYPLEECYAVFISNERKMIPIWKQQARPGDGPVIWADPQKPPLLLVWSRSLQTFSSAFTCMQMYF

SEQ ID NO: 784450 - protein, 205 aa, Homo sapiens; identical to SEQ ID NO: 784440

SEQ ID NO: 784451 - protein, 206 aa, Homo sapiens; identical to SEQ ID NO: 784441

SEQ ID NO: 784452 - protein, 188 aa, Homo sapiens
AVRRVLDPTSGPVGLPPARALAQLAGHGSEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKMKW

SEQ ID NO: 784453 - protein, 73 aa, Homo sapiens
GCTASFRSYVWSSRSSSGPGPGPASRPWKVMAPLLSTTSRPAPRGTPASTAAATVKKIFGSSVNTSKTMTSIL

SEQ ID NO: 784454 - protein, 72 aa, Homo sapiens
SPASLQEGGRRVRVREEMWQQKQRPEGCGARSQGTQAPLETEKGKEWILPWSLQVEHSQVNPFLTPDTSRMW

SEQ ID NO: 784455 - protein, 79 aa, Homo sapiens
SSRLKAALTMTEKDPTAKLIIVKCQNPEDKERGASESLGYCKYLGIQRANKHEQLGDNGTTDDSRNQLKRLFGLEFFCF

SEQ ID NO: 784456 - protein, 109 aa, Homo sapiens
MSVKSWDITRKSSSSRLIPEWKNLKFLINKILKDIKNDEEPKNDVVLLSDWPETLYRESHHPQNKPFVCFYYSIKVNCFVSLNWMEPCGKMQARNYRRNHSGPTAEYSS

SEQ ID NO: 784457 - protein, 119 aa, Homo sapiens
FFFEFCSITSLVLYFFSLDLYRQEIIGEITLGQLLNIQAEDIQSLLIHVEQQLNENLTLLQREKSFTFSFDIPWSEELKVFSEDMCIPLSEPVKITKPKKRKRHFQARSRKLSMYRVIY

SEQ ID NO: 784458 - protein, 150 aa, Homo sapiens
ACDGSQVVMAPRFPSPGTPGLSSPTCLYSAPCSTNAPIPIHSAARVRNPLGAADPWLPASSPCACSLTPVTAPLHFRWSPDPLGCTPPSLPTLRPKSPALSHSAADPLGRGLRTVLGASVATCPSRLLSSSAQGDPAMACSFLKRAQSGT

SEQ ID NO: 784459 - protein, 195 aa, Homo sapiens
PPATQHTETLHFSPALSLLLPFLYPLPGIHLGTSSLLHASRSPSSRVKPDPILESSHFPSPGTPGLSSPTCLYSAPCSTNAPIPIHSAARVRNPLGAADPWLPASSPCACSLTPVTAPLHFRWSPDPLGCTPPSLPTLRPKSPALSHSAADPLGRGLRTVLGASVATCPSRLLSSSAQGDPAMACSFLKRAQSGT

SEQ ID NO: 784460 - protein, 183 aa, Homo sapiens
PICTMRTKLCPLRLFPALTHCDSEILNPIAVSSGESRPCLMGAPPFPPPPHLTLQWLWESTHIFWKTDPHAQACPCMTAHSSGPGTSSCGQRQGDEGPVSAKAPSGGWHPSSPSQQWRKPLGLPQGSRLGWSQRAGPRVKVITAERGPKGSPCLVTVNSDCDDDDCDKGTRGRCQSSRLCRGT

SEQ ID NO: 784461 - protein, 66 aa, Homo sapiens
GHLRSREVQHLLSIAPCVGLNQGRSSDLGICMLRTGYLSSVWCETASVRSLDLGAGSPGLRSFFWG

SEQ ID NO: 784462 - protein, 352 aa, Homo sapiens
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 784463 - protein, 273 aa, Homo sapiens
MRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 784464 - protein, 352 aa, Homo sapiens; identical to SEQ ID NO: 784462

SEQ ID NO: 784465 - protein, 395 aa, Homo sapiens
FFATGCLEFIFRLVPGAQFQVSGKLRVLGPGGRERGSHWFLVSAVLMRRSACCSRLVYRVGGGRWEGIFYFQSMLHPSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 784466 - protein, 106 aa, Homo sapiens
GREATPILPLSLAQLCPAPPGLRSARRGPCSCAPGALPGHPGPRSQDKAMKPALLEVMRMNRICRMVLATCLGSFILVIFYFQSMLHPGRGRVSVVLLDIFFSLAL

SEQ ID NO: 784467 - protein, 117 aa, Homo sapiens
PQSTTSKTSALSLWLAGGSEQASSSIPLPLCKPPQTGTDCLQQSRRAGEAETPGQGYSQHHTLSPMTGSSPQCYGKAGLSSGNRRWGGDVTGRWQWDPQHLSARSVPDCMLLTRPRI

SEQ ID NO: 784468 - protein, 84 aa, Homo sapiens
PSIGSPGLMPQVTCALSLALPAPRHDGYRCLCEAVLTAHSVPLHPTPSVPLRGRLFALPPIPGFFRLRAQRKAADTKKQLWGVW

SEQ ID NO: 784469 - protein, 35 aa, Homo sapiens
KLRHLCNAGDRILPNLIKNTLMEKYRPGYRKNSKE

SEQ ID NO: 784470 - protein, 183 aa, Homo sapiens
VQQIGILKPHPAYVQLLEKATEPTLTFEAVDVPMFCPPLPWTSPHSGAFLLSPTKLMRTVEGATQHQELLETCPPTALHGALDALAQLGNCAWRVNGRVLDLVLQLFQAKGCPYLGVPAPPSEAPQPPEAHLPHSAAPARKAELHRELAHCQKVAREMHSLRAEALYRLSLAQHLRDRVFWRP

SEQ ID NO: 784471 - protein, 110 aa, Homo sapiens
VGSSGRGVCAGVDESVHLCKKGWMREWNSDWGLGSEKGCQPSVVSRSFQAQVWCVGRLGEKVGPPTSLDTQEASGDPGQFLQEDMDAFGVYLLYSFLPHHAVACTACAGN

SEQ ID NO: 784472 - protein, 139 aa, Homo sapiens
QRCLARLHALHIFVERVISILVECIIQPIMPLIKSFFSHVTNLLFKIFYLPTRKNDLIFVPFPSQKKKKNYLCHMRCDKNWQPFPEIFLQRFTMCYIEKRTKSVISVYEITRLFSCPLIKVHLILTTQDKRDSKGHEFH

SEQ ID NO: 784473 - protein, 45 aa, Homo sapiens
ELGTPATASDEDCLYALYDATYETKRARRRTWCLSSGPLSLCPLR

SEQ ID NO: 784474 - protein, 117 aa, Homo sapiens
LEKRRDVQAEETRCCDKGVDPQGLGGPARELGLHPEEQENALKTAGTGAAWPDVFQRENSGSRLYSSQCPQFLDEETVDLSGAVICPRSSGWVVSIPSFCPRAPFTTPCYHPESSHC

SEQ ID NO: 784475 - protein, 330 aa, Homo sapiens
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 784476 - protein, 80 aa, Homo sapiens
PLRYGNRGVAGRLQLVIQPPGTDCRDPTPDPPRLGCQEGQRICTSELCALSQALDRLCSRSPSFEQGLTEEPALPGCCSK

SEQ ID NO: 784477 - protein, 108 aa, Homo sapiens
PPRVSENNKVQNIDYSESIPFRILFGHAKVDPDYPVTIVTSSLSSVLTVNIKTIHGRVRWLTPVIPALWEAKAGGLPELRSSGPAWATWETLSLLKYKKLARHGGVRL

SEQ ID NO: 784478 - protein, 106 aa, Homo sapiens
MAEIASGAWLPGLPRTQCILINKKEGPPPLTVPARVGKESTNLANFNDGKRFLSKSYLKTTPKPEFLQLLPGNTEIREMRQAGVEGAEEDVGTQERKRKWMGSSVS

SEQ ID NO: 784479 - protein, 103 aa, Homo sapiens
EVIRGSPLFPAQLGNRGQRFTHSTQRGIPQIFLSAWDVPGPMPAVAWLTPPPGLQPHGRGPQGQVTKKQVTWSCDPCSEENTGGGGGGSSGQACEKGGAPQRQ

SEQ ID NO: 784480 - protein, 78 aa, Homo sapiens
SNMIRLELVPGSSPLSLIIREMQIKTTMAYHLTPVRMVIIKKSTPGMVFVHQVRPPEVGTQHLQLALGPSLVVHDFVV

SEQ ID NO: 784481 - protein, 74 aa, Homo sapiens
PARVHWLLLALVLAWLSGQRMPPVSRPRVAAGTRETLPFEPMLQGLEAWVLTPGPLLCPQRLPSQAQYPCLPQP

SEQ ID NO: 784482 - protein, 84 aa, Homo sapiens
VTDSSEAAHLLPRLPLQVSPPLQLLVSLPGEPPGLIPRMRLSSGPGPPSPLTISLPEPSRYVPNSKSLSSPGCPQSFPYLQPDA

SEQ ID NO: 784483 - protein, 91 aa, Homo sapiens
RTLDEPERRQTPPVMPPPVRCPQQPPSSLWALKELKPQSLSFTMAETRRPLPGGTSPVSLCHPGWSAVAQSQLTANSVPRVHAILLPQPPE

SEQ ID NO: 784484 - protein, 93 aa, Homo sapiens
PGWGCPHPDPSSSGSAGRRSAAAVSVLLPWDEVAAQHDRRRQQQLEGAEPCHPTSTCHALLTQFMGFALFSPLLNKVHINNSAQLCCGTNNLE

SEQ ID NO: 784485 - protein, 108 aa, Homo sapiens
TGWIKVGMGEGVEGELGGRGLCGTETPSRDGEKGCWPPKLPGLILFWLVSAGEVKGPKAWIWRGGNMERWGYGEAGIRRGGDKESGPAAPLVNQNTFSGLFPGWREGI

SEQ ID NO: 784486 - protein, 95 aa, Homo sapiens
MGTHRKENATGTHRGRTPGEHTEERTPREHNAGELQVNARRGERLLNARGWRTPVNAGERTGKRTPREHTGETPHETIQQPRRLIRPLNLVVVVD

SEQ ID NO: 784487 - protein, 105 aa, Homo sapiens
PGCSRCRTAPGRRKGCTTSLQTLLPPAASPPPCGSPRDFVPYSLLSPGPGQRRRCWGFHQYPPTSPRGGKGRKVSGQVQRTDSYVSNSPGSFPGPPQAEQVVWMS

SEQ ID NO: 784488 - protein, 82 aa, Homo sapiens
NYPPMRHTLLPRPDRTRRPCVQHRCVHLRLRVHADVSTIIYNSPHGRQLMMDTQHVVRPHSGVLLSHKNERRSDRRYSEDEP

SEQ ID NO: 784489 - protein, 103 aa, Homo sapiens
TKPKTEERKCRRKEKMKRGRKEKSTPQLGHFHKIERSRATPSSSARPARPAGPWSQPFGRGERRAAEKSSLFITTDLTAAIVAATEFAPVGRTKAAGAHFTKK

SEQ ID NO: 784490 - protein, 124 aa, Homo sapiens
GGVWRMFQRPEPTGVGCGGEGVPRFHPSAPTHQESQAGCCRVMRRCADERRPESSSGRKDGPLSTSQHEAHWHRTPPPPAVLAAQKHPAPASHPEVSPPYGCPQPPLPNGSVGPLVLLLVHWNS

SEQ ID NO: 784491 - protein, 191 aa, Homo sapiens
CQASQHRPLPFAVIAMQGKSPSSQADVLHKAARTCNLATSIHHLGSPLRPDPCLVIKKYLVMAGDPPGDWMGDGGSDDGGVSEDSGSENGGKDRCEGEGKGGSKDGSEGRSKDEGEDKGEVEGEDKGEVEGEDGGEDGEQEEGEDRSEVGEENRREDRDEDGGERGTVSEKRVRMEGKIEVRKGEQRGGWR

SEQ ID NO: 784492 - protein, 82 aa, Homo sapiens
MDLGYPRHSVQFKWYVDGVEVHNAKTKPREEQYNSTFRVVSVLTVLHQDWLNGKEYKCKVSNKALPAPIEKTISKTKGGTRG

SEQ ID NO: 784493 - protein, 67 aa, Homo sapiens
HSGPNSPHETQRLPSAAEEQGGINGIPNPRESSPRMGANFRPIVTRWPHLYCSPFSEDLLKATWCLW

SEQ ID NO: 784494 - protein, 105 aa, Homo sapiens
MYRPTHHWGMYRTPHRGTARDGGCTDPPIVAQPGVRGVQTPPLWHSQGWGVYRPTHHGMPQMPRQREWVVGELATASLWAQALSTHLAVNPPDPPRAPALPCHPA

SEQ ID NO: 784495 - protein, 47 aa, Homo sapiens
HLFVMPSLISALNYTLCSREAGSIKKSIDGGGGGGLHRFEVDSNPDN

SEQ ID NO: 784496 - protein, 80 aa, Homo sapiens
SNTHSSTFNVRAGIALNNHFVKIISWYSDEFGYSNKVVDLMAHMASKRKTTRPPAPERAWEEERGRHCWGVPATLSPPLH

SEQ ID NO: 784497 - protein, 135 aa, Homo sapiens
HWKEKERRKKERKKGRKERKKERKKERKKKKEKKEKERKRKKEGRKERKREKGRKERRKEGRIAGRLRQENGANPGGRACSEPRSRHCTPAWATERDSVSKKRERKRERKEGRKRKERKKERNGRPGREFSSSSR

SEQ ID NO: 784498 - protein, 90 aa, Homo sapiens
WVDRGLWVDRGLWVDRGLWVDRGLWVDRGLWVERGLWVDRAFLSDIWQLWASILSAQHWIPVTSRLSAADSSVLSFMPLSNHPSIRSFIQ

SEQ ID NO: 784499 - protein, 105 aa, Homo sapiens
STTTTKFAAASSCVPGQGGHGVARSRERVKRLVLVGPLGAFVMRGGENPLQQCKQGSDIIHICLCRKCFRHCGDTGVAVERLPGRPLQLSRQEVVGAGTAAGLDL

SEQ ID NO: 784500 - protein, 743 aa, Homo sapiens
MFTWASVLPERLPVLVLCRLARPTGLGVDPNEGAQCRPCCVQAAVGNVCLRKSVPRWPRVVCHRPAPITWARGCCQMPVFPCRPRSRKARCKLGMLELLPWSVKALIIDGSYWRSIPKYPKVESLLGTIMRNGNLGPLQSKAHLVPMFKIRLRGPFGVRSKEGKGLMQVFPCGLDLVHGVQSPFWGRVSRFLVYTYIQASAPPSGDRAHSPHCPTPRARDTRPATMTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRIVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 784501 - protein, 743 aa, Homo sapiens; identical to SEQ ID NO: 784500

SEQ ID NO: 784502 - protein, 743 aa, Homo sapiens; identical to SEQ ID NO: 784500

SEQ ID NO: 784503 - protein, 743 aa, Homo sapiens; identical to SEQ ID NO: 784500

SEQ ID NO: 784504 - protein, 669 aa, Homo sapiens
MFTWASVLPERLPVLVLCRLARPTGLGVDPNEGAQCRPCCVQAAVGNVCLRKSVPRWPRVVCHRPAPITWARGCCQMPVFPCRPRSRKARCKLGMLELLPWSVKALIIDGSYWRSIPKYPKVESLLGTIMRNGNLGPLQSKAHLVPMFKIRLRGPFGVRSKEGKGLMQVFPCGLDLVHGVQSPFWGRVSRFLVYTYIQASAPPSGDRAHSPHCPTPRARDTRPATMTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRIVGSPFDPTTEQGPQIDKKQYNKILELIQSGVAEGAKLECGGKGLGRKGFFIEPTVFSNVTDDMRIAKEEIFGPVQEILRFKTSMWNMGNIYIAFCI

SEQ ID NO: 784505 - protein, 383 aa, Homo sapiens
MFTWASVLPERLPVLVLCRLARPTGLGVDPNEGAQCRPCCVQAAVGNVCLRKSVPRWPRVVCHRPAPITWARGCCQMPVFPCRPRSRKARCKLGMLELLPWSVKALIIDGSYWRSIPKYPKVESLLGTIMRNGNLGPLQSKAHLVPMFKIRLRGPFGVRSKEGKGLMQVFPCGLDLVHGVQSPFWGRVSRFLVYTYIQASAPPSGDRAHSPHCPTPRARDTRPATMTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWASRSF

SEQ ID NO: 784506 - protein, 227 aa, Homo sapiens
MRTWLFPLVVDYAVEQAHQGVFFNQGQCCTAGSRIFVEESIYEEFVRRSVERAKRRIVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 784507 - protein, 422 aa, Homo sapiens [sequence omitted]

SEQ ID NO: 784508 - protein, 743 aa, Homo sapiens; identical to SEQ ID NO: 784500

SEQ ID NO: 784509 - protein, 742 aa, Homo sapiens
MFTWASVLPERLPVLVLCRLARPTGLGVDPNEGAQCRPCCVQAAVGNVCLRKSVPRWPRVVCHRPAPITWARGCCQMPVFPCRPRSRKARCKLGMLELLPWSVKALIIDGSYWRSIPKYPKVESLLGTIMRNGNLGPLQSKAHLVPMFKIRLRGPFGVRSKEGKGLMQVFPCGLDLVHGVQSPFWGRVSRFLVYTYIQASAPPSGDRAHSPHCPTPRARDTRPATMTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRIVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWDPIVHAFKPPFGGSRLGNKGWCGLLQFKNGGQKIPPKKNSLKKAQKE

SEQ ID NO: 784510 - protein, 108 aa, Homo sapiens
MGFIQEGEQDQHQHRAGWRPAKPTCPFGSTPLFFPRTLLHPPPPAASQLLQDLCPVPEDTTDLGTPAQCPEDHQRANGQHLQEASGKWGRGPKPKVPSILATLSPGPA

SEQ ID NO: 784511 - protein, 164 aa, Homo sapiens
PGRLNAITGGTRRSRRATAGPGQACCGRRKAPEVGWEGEAERRVSPRPRCRQRGAYGWQPGLGSRVLGARLGNRTSLRGDLCTAPGPPPPCWQPPPQRTKPRHPDSRGAAAAKSSAPPSLAAASAGKCSPGFGAMEPRRKRRVSAAERAEGTEGAEGTNHERPR

SEQ ID NO: 784512 - protein, 158 aa, Homo sapiens
AGGRGAGAVAVVAAEHTDFIVEAHLELPHLLTVPADQAKVQAAFHDLAQLPQGDTRLGLGTALEAQGLLTDGPSGRTDVGVGVKVPARGPRHGVAVSSHSDQAHWGSQPMVTTVVIGADVGLLGSRVEVRVLLGVAVAVVLEVALVWPGVVVPGEGGD

SEQ ID NO: 784513 - protein, 94 aa, Homo sapiens
KFSSHYPNSSGPLLPAWTLTDANIYCVCPDGQNMDLALEKLSEGRQIHEQFLPPAAGDRSPCAVATLTQEGQKGFLRRCPEPGSWTVRVSQVTG

SEQ ID NO: 784514 - protein, 123 aa, Homo sapiens
VGTGVDAGVGVDVGTGVDADVGVGVGSGVDACVSVGVGTGAGAGVGVGVGTGVSVGVGTGVHAGMGVGTGADAGVGVGIGVDAGMGVGVGTSVDGGVGMGVGTGVDAGAGAGLSGREFSSSSR

SEQ ID NO: 784515 - protein, 115 aa, Homo sapiens
MVSQGHSEKRAQSPESKHAALSPHFPLNMVLSTKSGLRILKHLQALGPHPLDSPGTRSLGLNNGKLWYWALYSCIFNRNKTMMCGVSHPFSLPFPLRATFVFANLSLGFGDTEAV

SEQ ID NO: 784516 - protein, 59 aa, Homo sapiens
LVNESGSWLDRRNPRVSQPKHTIHGIKKGTATPMVSPVRNASFHPAKICLCPSCLLNTS

SEQ ID NO: 784517 - protein, 82 aa, Homo sapiens
HRLIITARLYNLKLGFIPILPLAMNYPADTFILSTTVLFQRVHSLPGPHQGNNLQKAASDRNEPVDHEGQGTLKNEIDKTAS

SEQ ID NO: 784518 - protein, 103 aa, Homo sapiens
MPRVTALPLSCYSGQTAYGVYLLHKEQCLCCCTLLFQQKLLYNITHSPLNSFLSKAKNIPRLSPASISADPRLHGEVYMSWIFFYQVFGPPFPLDNNPCGWDW

SEQ ID NO: 784519 - protein, 107 aa, Homo sapiens
MTAGRAAADLEPGLCAGFKPQGPARESGPVSPPLFPPRAGRRGEGGQCTQGSGQQVTQPAALSLLCPELGPHGSGRAARAAHGGAAPTLHSAGPTANLPSTSPRERS

SEQ ID NO: 784520 - protein, 367 aa, Homo sapiens
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAWNYSFSQLPRFLSGSWSEFSTQPENFLKGCKWAPDGSCILTNSADNILRIYNLPPELYHEGEQVEYAEMVPVLRMVEGDTIYDYCWYSLMSSAQPDTSYVASSSRENPIHIWDAFTGELRASFRAYNHLDELTAAHSLCFSPDGPSSSVASTGLCVFFHGPAGRDAKSEAHLEKSRDRAVLPGSLPANSLLGLGALGVCRIWPRVGATVPPVPRAVRPVLCR

SEQ ID NO: 784521 - protein, 59 aa, Homo sapiens
VKMAARLINEINVENVVVIEMRDDCGLNQKMAIEMEKMDGFKRYVKAGISKTSLIEYGA

SEQ ID NO: 784522 - protein, 202 aa, Homo sapiens
RRKWVIQIVERETKTKAYSKEALGLAQKVDPAQKEKEEVGQWLTNTIDTLNMQVDQFESEVESLSVQTRKKKVDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTGSLDDLST

SEQ ID NO: 784523 - protein, 172 aa, Homo sapiens
ALQPLSLALGSPAKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKTAPSLSTATSTLSPQLCR

SEQ ID NO: 784524 - protein, 197 aa, Homo sapiens
RRKWVIQIVERETKTKAYSKEALGLAQKVDPAQKEKEEVGQWLTNTIDTLNMQVDQFESEVESLSVQTRKKKVDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSPASAQASPHHQPNRITRSGIRVE

SEQ ID NO: 784525 - protein, 82 aa, Homo sapiens
MAQQTGQPSSSVQKAVSPIRRPGKGSTIFPKGEPRAEVLPLQEVRCSRGLLGLVWGLQWSQLDTCSTPATSAPTLCSIWHLH

SEQ ID NO: 784526 - protein, 42 aa, Homo sapiens
MRFDKLDGSARDDGKIGQGCKRPELSSHIRYYLHCNHTSQKN

SEQ ID NO: 784527 - protein, 40 aa, Homo sapiens
VFKMETPIVKVNNSSSNNSSPPQARTGRRVNRHGARCFGQ

SEQ ID NO: 784528 - protein, 77 aa, Homo sapiens
ANHAHHSAQCLPWTSISPKPPGPQLSRSGFPTPKARVGARQGDSRSSTSSETPDSQGLTEDLPCARHWVPRSTHHPP

SEQ ID NO: 784529 - protein, 165 aa, Homo sapiens
EKEESSRDWEEAACLSCRSIFTQQSSHVSAFLDLIYKRWQLIKGPLRFFPHLNSKALLSSSKRKQMSLVAHATQKTGEAVFGEIQGLPCDSPRKEIQYEKDTRDTNSSLYQDQAQGLAVQTGYVHWGECYRKGKFIHLFFSLVRERMIQNSLSYHMHMVVVLSSG

SEQ ID NO: 784530 - protein, 63 aa, Homo sapiens
THLRRNDATILRNTRTKPGSDRASGSAIFLKCSFTERAKDRTPCPCPHPRDIKTRGNTRSAIS

SEQ ID NO: 784531 - protein, 70 aa, Homo sapiens
GEHEAQEQNAEYSLSWIAKSVPGHASSGPFLKPAVELAGCGSQVDCKSCSPAHGAVRKLALHCLLQKAGS

SEQ ID NO: 784532 - protein, 321 aa, Homo sapiens [sequence omitted]

SEQ ID NO: 784533 - protein, 356 aa, Homo sapiens
MQMSYHRAQQAGMSIKASPGIWSLSSFLRLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSSVAEFSEATAELTVSFTNKVFTTETSRSITTSPKESDSPAGPARQYYTKGNLVRICLGAVILIILAGFLAEDWHSRRKRLRHRGRAVQRPLPPLPPLPQTRKSHGGQDGGRQDVHSRGLCS

SEQ ID NO: 784534 - protein, 339 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSSVAEFSEATAELTVSFTNKVFTTETSRSITTSPKESDSPAGPARQYYTKGNLVRICLGAVILIILAGFLAEDWHSRRKRLRHRGRAVQRPLPPLPPLPQTRKSHGGQDGGRQDVHSRGLCS

SEQ ID NO: 784535 - protein, 346 aa, Homo sapiens
MPRGCDPNNPGGVSGRGLAQPEEAPAAQGQGCAEAASAPAAPPADPEITRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLGGLRWENGLSLGGRGCSELRSHHCTLARVTKPDLVSKNTGMNMSITLI

SEQ ID NO: 784536 - protein, 97 aa, Homo sapiens
SQLRCWLLPSTSDFLFLPGVFAKPSLSAQPGPAVSSGGDVTLQCQTRYGFDQFALYKEGDPAPYKNPERWYRASFPIITVTAAHSGTYRCYSFSSRD

SEQ ID NO: 784537 - protein, 131 aa, Homo sapiens
DGCEELEFPLPNGFKEESYMECSDFLGYPLWPPYPVRMVNRQLQPLPPDKGKTTKALDILGKKVEGQSSQIQKLPRSAQALASVGDFQTQRWRRSLQTLVIATQSAALVETGACFTDTFKLNVCRGYSQPL

SEQ ID NO: 784538 - protein, 160 aa, Homo sapiens
HAQRREIENEQQRIYVNGDWTQRGGVVSRVKVRSSVVIEDKSTRDPEDVYSQPYGENQLPVWIPTRHLKFYNAPIGDAKKSTSAETETPQSSTVDSQDEQNGDIRTDEVAIHQEVCRCTQQLRRDSDHRERAMMTMVVLSKRKGGNVGKSKRDQIVTVSV

SEQ ID NO: 784539 - protein, 74 aa, Homo sapiens
MRLWVSLSAAEQDDRMAQKAAWRVALPLAQAGEPADTVTLTAPWHRFHPNTGFSEHRLLPSLSHDPEATRAWAA

SEQ ID NO: 784540 - protein, 101 aa, Homo sapiens
GGDLLHNNKQLRHQPNPSSPRAALLLLLNRQSCCQRPTVLGKEPHSHPPLFQLSLFPSWAWGRLGGLFMGLCTCISLHSTVPSSSLRACKPRVVSCVSSNF

SEQ ID NO: 784541 - protein, 111 aa, Homo sapiens
DGKKLCPPGKASSSEKIHERSGPKRGKHAWTHRLRERKQLVIYEEISDPEEMTSNSISEPSAHPPHPCRCAILLCLRDTTHAHDEKQNVVTFHERGHGCGPLVIRCIASES

SEQ ID NO: 784542 - protein, 102 aa, Homo sapiens
RCFGAWRGRSHAWGGWETALSKYAKSKQSRHLGSKIFIRTISFPLMQKTQPSCDLVSGHSDQGAKGQESLPDHQTEQKGGSQDLESGDRWSELERMDHRKSI

SEQ ID NO: 784543 - protein, 81 aa, Homo sapiens
DVTDKDVTDKDVTNFPSPSPRNQPSPPSNQAQPVAQTRRPYDTMDAGHMPVYTQSQILHLTPTKTSTFGQAPWLTPEIPAL

SEQ ID NO: 784544 - protein, 130 aa, Homo sapiens
ILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTR

SEQ ID NO: 784545 - protein, 47 aa, Homo sapiens
MPLGVSHITQVFGGKPKHKSGRLVRPNSLPEPELESVSLPFHSSRTG

SEQ ID NO: 784546 - protein, 104 aa, Homo sapiens
MCPSEMGTLWHHWSPVLISLAALFSKVTEGRGILESIQRFSLLPTYLPVTYHIQNADVSFFVKEANQDIMRNSSLQSRVESFLIYKSRRLPVLNASYGPFSIEQ

SEQ ID NO: 784547 - protein, 76 aa, Homo sapiens
KYPIWTQQNGRRLGVIPRAGGKGVLMSPPPALPLHSRHPGEQGLGHHLVRGLQQAGGSGPAGFAMGSQHLCPAQEW

SEQ ID NO: 784548 - protein, 83 aa, Homo sapiens
PVLLTQDMASGAMAPGWLEGSEWVISRSQQLLGSYTPRGAGDTVGCPAFLQRHAGPWIETGPRQGMCHGGFDARSFESQERTD

SEQ ID NO: 784549 - protein, 165 aa, Homo sapiens
AEQLRRQEGGAAAQMRQEIERLTERLEEKEREMQQLLSQPQHEREKEVVLLRRSMAEGERARAASDVLCRSLANETHQLRRTLTATAHMCQHLAKCLDERQHAQRNVGERSPDQSEHTDGHTSVQSVIEKLQEENRLLKQKVTHVEDLNAKWQRYNASRDEYVRG

SEQ ID NO: 784550 - protein, 41 aa, Homo sapiens
HFPATFLEAVLNFEDLPIWTVKSIAKDTPFSLLNSGEALKH

SEQ ID NO: 784551 - protein, 69 aa, Homo sapiens
SGEYGRGSTTSPQAGACRQGAHTGREAWLPSEGSSPVTGDVGPGQVLLAGSSGYLVGFKFLESHGSDSG

SEQ ID NO: 784552 - protein, 43 aa, Homo sapiens
FPPQWSSPHQASRETQFPRLFVPMRESGAEPLRDPEWRDLPFS

SEQ ID NO: 784553 - protein, 180 aa, Homo sapiens [sequence omitted]

SEQ ID NO: 784554 - protein, 42 aa, Homo sapiens
MNIMKACWPWALVTLDRTSRIHTIVGPPSAHEFHRPRSRSKR

SEQ ID NO: 784555 - protein, 104 aa, Homo sapiens
MKDFSFQTGHLICQMTIMCATYMYFQQVPGSQVLGKLMTGRLSYRTSSLWKRLTAAHLIRAVMKSWINSDFCFSLASKEAYVLWHHVMVIRSQLLPVLLREAKC

SEQ ID NO: 784556 - protein, 151 aa, Homo sapiens
DQRVGPRFTEGVCQVGSEKAAPFSLLFWATGNPPRDRCWSAACGTLHFCLRVALKRQLPIRVPCSPVCCGLWEDVPVLSQAQCSHSTETRGVWSPQSPSCLVSAGLRAGAYSHEVFTSHTLSLATGRSSGRRGWDTREPTRGQSSSAPPSA

SEQ ID NO: 784557 - protein, 265 aa, Homo sapiens
MAPSRNGMVLKPHFHKDWQRRVATWFNQPARKIRRRKARQAKARRIAPRPASGPIRPIVCCPTVRYHTEGARRPRLQALGKELRGAGGLCLGIYFSPNNRNPRFWWGGHLVNPPKSSQVGRTLFLHPLSGFRGRQTFPPQCEQPGRGTLAGPWHEHKPKTWDFPPKRRGQSISTFDPNVYAGPPKAERCAQIVPRRGPTLLVQTTAPGPTPRPILRSPSPPERAPSRVIFTPPPPHHFAEPPPKHPRVFFPHAKNSFFPPPHIPA

SEQ ID NO: 784558 - protein, 178 aa, Homo sapiens
MAPSRNGMVLKPHFHKDWQRRVATWFNQPARKIRRRKAPAAASAWRSSGWPAFTRRWPGPSAFLWIRGGGTSPRSPCRPTCKRLKEYRSKLILFPRKPSAPKKGDSSAEELKLATQLTGPVMPVRNVYKKEKARVITEEEKNFKAFASLRMARANARLFGIRAKRAKEAAEQDVEKKK

SEQ ID NO: 784559 - protein, 107 aa, Homo sapiens
MAPSRNGMVLKPHFHKDWQRRVATWFNQPARKIRRRKAPAAASAGGAQGGRHSQEGGPDHRHFCGSEEAEQVHGVPAGQRAAAEGVPLQTHPLPQEALGPQEGRQFC

SEQ ID NO: 784560 - protein, 292 aa, Homo sapiens
MAPSRNGMVLKPHFHKDWQRRVATWFNQPARKIRRRKPCAQGLAPWWLVPCCDLPPCAFAGLADLPRGGGVLLVLQPVAGTPCLALGVALRANGVDLPACASRHTQGLYMCPVLIAQLACSLLFCFPDSPLLFGVFHNSPGPKFLLAGLLPQHWFLGYFPCIWRWVACCTGVLVLLLYKALGVLANCFLELVGCYRDEFPRNTEQGWCAREKPTPRQLLRWWRMSPEWCNAHVPTPKASPQVLVYPPISNCNTIPGCRSRHALKRGYAIPKSPNPVHLPLLSPPSRQIAHFR

SEQ ID NO: 784561 - protein, 225 aa, Homo sapiens
MAPSRNGMVLKPHFHKDWQRRVATWFNQPARKIRRRKARQAKARRIAPRPASGPIRPIVCCPTVRYHTKVRAGRGFSLEELRVAGIHKKVARTIGISVDPRRRNKSTESLQANVQRLKESTRIQRLVTSCLAKSRAPSRARSIGMWRPEIRVDMKREIVDIPELTGPVMPVRNVYKKEKARVITEEEKNFKAFASLRMARANARLFGIRAKRAKEAAEQDVEKKK

SEQ ID NO: 784562 - protein, 522 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 784563 - protein, 148 aa, Homo sapiens
AVQAPPRSPAGRAGGRSLGRLAGRGSAAPVVAMAAVVAATRWWQLLLVLSAAGMGASGAPQPPNILLLLMDDESLPPPRAAGSPRWAPVLPDGCLCPLENAERSDCFPEHALQRPGVRVLTAVAGPFSALSGISLLKILCFRISSFHF

SEQ ID NO: 784564 - protein, 85 aa, Homo sapiens
SPRGSPSAALPAYTPQEIVGGIPDSEQLLPELLKKAGYVSKIVGKWHHRVTMAPKFQAPHGKATGLLTGRCGIWNSRTKLGPTYL

SEQ ID NO: 784565 - protein, 525 aa, Homo sapiens
IFSALENPEETHLGSRHDPQNSPGSSENVEGRSRGHEGHVRRVPGGWEAPHDAPPFTVQGTPAAAMPAALGCAQTLCRVGGQCQHPPRVRPWSFVPAVPRHSPYSVLEGARLTKNFVKVVSVAAQNFRVSPRGVPEVSWVPVSRHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 784566 - protein, 504 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCGSH

SEQ ID NO: 784567 - protein, 260 aa, Homo sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHGPWPSGRGWPSRRGVRARFVSGYV

SEQ ID NO: 784568 - protein, 281 aa, Homo sapiens
GRPGPAPQPSRKGRRTLARSARWPGLRGSRGCHGGGCRGDEVVAAVAGAQRRGDGGLGRPAAPQHPAPAHGRPRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDFQFRLSFVHKEFPWTLIMREACSFLSL

SEQ ID NO: 784569 - protein, 180 aa, Homo sapiens
IFSALENPEETHLGSRHDPQNSPGSSENVEGRSRGHEGHVRRVPGGWEAPHDAPPFTVQGTPAAAMPAALGCAQTLCRVGGQCQHPPRVRPWSFVPAVPRHSPYSVLEGARLTKNFVKVVSVAAQNFRVSPRGVPEVSWVPVSRHLGHRPQFHPLKHGFDEWFGSGGLIRLGGPRNLLFP

SEQ ID NO: 784570 - protein, 482 aa, Homo sapiens
CGEGEAPSGSGRGVQAWGLGGHRSPHALPLCCMTGTASSLAARAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 784571 - protein, 522 aa, Homo sapiens; identical to SEQ ID NO: 784562

SEQ ID NO: 784572 - protein, 322 aa, Homo sapiens
AVQAPPRSPAGRAGGRSLGRLAGRGSAAPVVAMAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDFQFRLSFVHKEFPWTLIMREACSFLSL

SEQ ID NO: 784573 - protein, 78 aa, Homo sapiens
STPWPRGFPLAGVAASVNGDHSSLASGGSRGRKLTSGPGCPRGQVSLFSLGTLGREVWGAGAAPWLSGGQDCREDAPL

SEQ ID NO: 784574 - protein, 72 aa, Homo sapiens
LGMGTLFMASLHRGSRFRTEALHAPGSLLSEHSPPLLLLFGMLDFLCTCSHTETGFLLSCACESHPSVSPAV

SEQ ID NO: 784575 - protein, 93 aa, Homo sapiens
EQGQQSRMSRNAIIKMIQNEKEAEDKAQCETRVRAQQTSTTGFESESFCFSATAPGLHSLKWPCQCWSQHSRVLNTPELKQSIPLSNKIMDSE

SEQ ID NO: 784576 - protein, 77 aa, Homo sapiens
NWVPGPHISISHSWGAGRRPLVLERQICKASDLWLNTPLRGFWPPGSAGEGMACGPPAFPRQAAWLAFGGWQRLADS

SEQ ID NO: 784577 - protein, 103 aa, Homo sapiens
MEQTAWAWRAGDQVEAAQLCLNSFSHRFPGRHSWQPLRPMTGTVNSLRQKGKDNTNVPMNPRNMKEGHTPTVEHVEAECGSVKGDGAPGPSMFRAACLCSDGR

SEQ ID NO: 784578 - protein, 85 aa, Homo sapiens
MSFPLIKPEALQTPHLFHSSLLSHMQTIIKPWQLNFRIYPKSATPHGLLSKYPTQAPSVQAWVIRVAFKLIVLLPLSPYPISHPD

SEQ ID NO: 784579 - protein, 145 aa, Homo sapiens [sequence omitted]

SEQ ID NO: 784580 - protein, 68 aa, Homo sapiens
QKPRFSGASLPRTRLLALCHRSLAWHHSDSPGGSSVRGAARSAAIGAVNFSFFLMLTDTWGYRGACGG

SEQ ID NO: 784581 - protein, 111 aa, Homo sapiens
SVAHAGVQWRHLGSLQLRPPGFNPFSYLSLPNSWDYRRMPSRPAKFLYFLVETGFHGVPQAGLKLLSSGNPPTSARAIFYSPLPNPWPLPPLFILLPLFGKSSFSSLGLFK

SEQ ID NO: 784582 - protein, 99 aa, Homo sapiens
TGLPSTWCLQDVGGRKRILVPLEVSCHQLQVTWPGSQMVPQYLPLLLIDPRGNQTGAVLITDEGLAERKSQIQISLFFFRQGLALSPRLLIELLTSGDP

SEQ ID NO: 784583 - protein, 68 aa, Homo sapiens
LRHLLAESGCDWLKYHPPLPQNTDAALKSALKANTPGASCSCTRPLAHIAAQQHMAAPDKPSGATETP

SEQ ID NO: 784584 - protein, 122 aa, Homo sapiens
KKRRERPPDRPKPARRCIPRPAPTSAAVAAATMPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 784585 - protein, 174 aa, Homo sapiens
MPKRKAEGDAKGDKAKVKDEPQRRSARLSAKPAPPKPEPKPKKAPAKKGEKSHRKFSCSQTWVPRLPASEAAAAGHRGNVWRASLRMTRPSLVHPHSLPGDTMCLAMTHTRAGDRLPRPGVSTGEPEVTVVERSCTYVYQTPTHGAHCAASVEAHTMAKPPPHETYRETSKHST

SEQ ID NO: 784586 - protein, 110 aa, Homo sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTT

SEQ ID NO: 784587 - protein, 173 aa, Homo sapiens
MTEQKKKKKKKTNSVGREHRALRKRYKKPKRRAAGAQEGTRRQGATKEVPTETTRGTRTKAQGDSTQQVKKTPGRNNRHVHGTQSQQGKHPSAATTYCGDTTRTPRGAVTKEQHAPPNPTKNNDTTEHVGRHTSRPRRRRATHSRDATTTSQQDAENQQDSNNDKPDVNRGRT

SEQ ID NO: 784588 - protein, 105 aa, Homo sapiens
MKEESVSQCRSWASAGNFPDCPSGSQEWSSLAQFIPVSQRSQSPLCELGCPRSLGLSLCCPPWDLAPGVALLPLQLSSLLLVPSPGLCMGLALSSFLSLSPLFFL

SEQ ID NO: 784589 - protein, 96 aa, Homo sapiens
DAEKAFDKIQYPFIINTGNKLGIEGTYFHITKAIYDKPTANIILNGEKLNAFLPRTGTKQICSLSPLLFNTVLEVLSKAIRQEKEIKVFRIRKEEV

SEQ ID NO: 784590 - protein, 368 aa, Homo sapiens
FLIESHSHSDQSSKTSLMSEMRNAQSIGRRWEKPSPSNVTERKKRGSSWESNNLSADTPCATVLDKQHISSPELNCNNEINGHTNETNTEMQRNKQDLPGLSSESAREPNAECMNQIEDNDDFQLQKTVYDADMDLTASEVSKIVTVSTGIKKKSNKKTNEHGMKTFRKVKDSSSEKKRERSKRQFKNSSDVDIGEKIENRTERSDVLDGKRGAEDPGFIFNNEQLAQMNEQLAQVNELKKMTLQTGFEQGDRENVLCNKKEKRITNEQEETYSLSQSSGKFHQESKFDKGQNSLTCNKSKASRQTFVIHKLEKDNLLPNQKDKVTIYENLDVTNEFHTANLSTKDNGNLCDYGTHNILDLKKYVTDI

SEQ ID NO: 784591 - protein, 710 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGNFQYENFFNYVTNIDMLEEFAYLRTQEGGKIHLELLPNQGMLIKHHTVTRGITKGVKEDFRLAMERQVSRCGENLMVVLHRFCINEKILLLQTLT

SEQ ID NO: 784592 - protein, 710 aa, Homo sapiens; identical to SEQ ID NO: 784591

SEQ ID NO: 784593 - protein, 526 aa, Homo sapiens
LASTRLGVESAEEVLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGNFQYENFFNYVTNIDMLEEFAYLRTQEGGKIHLELLPNQGMLIKHHTVTRGITKGVKEDFRLAMERQVSRCGENLMVVLHRFCINEKILLLQTLT

SEQ ID NO: 784594 - protein, 339 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQEFRR

SEQ ID NO: 784595 - protein, 710 aa, Homo sapiens; identical to SEQ ID NO: 784591

SEQ ID NO: 784596 - protein, 693 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGKKKKKKKKQQQQTKTKTYKQNPRGASYCAGAAEDTAGIKRGAQGKQGVFETPRFVGHGGKNGAPPIKEAAKKRKSRDP

SEQ ID NO: 784597 - protein, 279 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRR

SEQ ID NO: 784598 - protein, 98 aa, Homo sapiens
SYGDILHRMKDLCRYMNNFDSEAHAKYKNQVVYSTMLVFFKNAFQYVNSIQPSLFQGWFTNFRVSKKPVHTVGMVRKMKVFIQYCWIRITVGRYQSFL

SEQ ID NO: 784599 - protein, 188 aa, Homo sapiens
WRRGLAPARSRACSLTSPRSRCSPQNENPLLRIFEVTWKRFNCSGFSEEEGTGGNEEPRGGDCSQNPEKLSRSTLPASVRLQTCAVASPAVAAAAAVAAVAAESPEPDVPAASGWRLESARVMSAQGDCEFLVQRARELVPQDLWAAKAWLITARSLYPADFNIQYEMYTIERNAERTATAGRLLYDM

SEQ ID NO: 784600 - protein, 280 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRS

SEQ ID NO: 784601 - protein, 736 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGNFQYENFFNYVTNIDMLEEFAYLRTQEGGKIHLELLPNQGMLIKPSSPPMGLLQQEFLPVLQPSIQTADRHHTVTRGITKGVKEDFRLAMERQVSRCGENLMVVLHRFCINEKILLLQTLT

SEQ ID NO: 784602 - protein, 319 aa, Homo sapiens
PGALLARQQQAVNSCWAVAVACGSCAIPGELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGSDLKLLPCTSKAIMPYCLHLMLACFKLRAFTDNRDDMALGHVIVLLQQEWPRGENLFLKAVNKICQQGNFQYENFFNYVTNIDMLEEFAYLRTQEGGKIHLELLPNQGMLIKHHTVTRGITKGVKEDFRLAMERQVSRCGENLMVVLHRFCINEKILLLQTLT

SEQ ID NO: 784603 - protein, 556 aa, Homo sapiens
MSAQGDCEFLVQRARELVPQDLWAAKAWLITARSLYPADFNIQYEMYTIERNAERTATAGRLLYDMFVNFPDQPVVWREISIITSALRNDSQDKQTQFLRSLFETLPGRVQCEMLLKVTEQCFNTLERSEMLLLLLRRFPETVVQHGVGLGEALLEAETIEEQESPVNCFRKLFVCDVLPLIINNHDVRLPANLLYKYLNKAAEFYINYVTRSTQIENQHQGAQDTSDLMSPSKRSSQKYIIEGLTEKSSQIVDPWERLFKILNVVGMRCEWQMDKGRRSYGDILHRMKDLCRYMNNFDSEAHAKYKNQVVYSTMLVFFKNAFQYVNSIQPSLFQGPNAPSQVPLVLLEDVSNVYGDVEIDRNKHIHKKRKLAEGREKTMSSDDEDCSAKGRNRHIVVNKAELANSTEVLESFKLARESWELLYSLEFLDKEFTRICLAWKTDTWLWLRIFLTDMIIYQGQYKKAIASLHHLAALQGSISQPQITGQGTLEHQRALIQLATCHFALGEYRMTCEKVLDLMCYMVLPIQDGGKSQEEPSKVKPKFRKGTVTCFMTIL

SEQ ID NO: 784604 - protein, 414 aa, Homo sapiens [sequence omitted]

SEQ ID NO: 784605 - protein, 286 aa, Homo sapiens
MQDHPNYKYRPRRRKQVKRLKRVEGGFLHGLAEPQAAALGPEGGRVAMDGLGLQFPEQGFPAGPPLLPPHMGGHYRDCQSLGAPPLDGYPLPTPDTSPLDGVDPDPAFFAAPMPGDCPAAGTYSYAQVSDYAGPPEPPAGPMHPRLGPEPAGPSIPGLLAPPSALHVYYGAMGSPGAGGGRGFQMQPQHQHQHQHQHHPPGPGQPSPPPEALPCRDGTDPSQPAELLGEVDRTEFEQYLHFVCKPEMGLPYQGHDSGVNLPDSHGAISSVVSDASSAVYYCNYPDV

SEQ ID NO: 784606 - protein, 51 aa, Homo sapiens
PAKLYDNLGYLPEQDGSGFEMRSERWTAKEKESLGSQCKSIIVGKICCVLK

SEQ ID NO: 784607 - protein, 768 aa, Homo sapiens
IVEEKLLSEETECLLRAQFSDFKWELYNWRETDEYSAEMKQFACTLYLCSSKVYDYVRKILKLPHSSILRTSGQEAGGKPGDCDGLEAKCRKYFKEGVVHYVKCCWEIRWLSKCQPSPGFNSNIFSFLQRRVENGDQLYQYCSLLIKSIPLKQQLQWDPSSHSFQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALGYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHIDLFVDVNKHLFDGEVCAINHFVKLLKDIIICFLNIRAKNVAQNPLKHHSERTDMKTLSRKHWSSVQDYKCSSFANTSSKFRHLLSNDGYPFK

SEQ ID NO: 784608 - protein, 730 aa, Homo sapiens
IVEEKLLSEETECLLRAQFSDFKWELYNWRETDEYSAEMKQFACTLYLCSSKVYDYVRKILKLPHSSILRTWLSKCQPSPGFNSNIFSFLQRRVENGDQLYQYCSLLIKSIPLKQQLQWDPSSHSFQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALGYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHIDLFVDVNKHLFDGEVCAINHFVKLLKDIIICFLNIRAKNVAQNPLKHHSERTDMKTLSRKHWSSVQDYKCSSFANTSSKFRHLLSNDGYPFK

SEQ ID NO: 784609 - protein, 99 aa, Homo sapiens
ARAEKKAAGKGDLHEDPNCPTSRVNPDSTLVENKKPQLVVTARDSRRACCLSVCAVSYSGVPLLRYPGEGRTEMPGLQEDPRKDCHLHTGSLGRQSSSG

SEQ ID NO: 784610 - protein, 105 aa, Homo sapiens
MVILERRKTVQTEATQLAAEVRTEGSPVQDVKDRQQLEIGFVLPATPAARNASQISAAASTSEVHFSSDEGCFSGHTENQQVQLRTKLNHNFWLKTLRQTYLPAQ

SEQ ID NO: 784611 - protein, 79 aa, Homo sapiens
HHRHVVDELLEAVPAGGAAPRVAGIEQRLEAAQQLGVAHLPAVLLQEAQHRRLAHPGSRSGGGGGQRHGGALGSWLPGR

SEQ ID NO: 784612 - protein, 81 aa, Homo sapiens
RPELPVFQNVLWNIQGTLTASHMLQWPLDAKSLVTAWHGPIKEGASSNSCVFHTCRIQVHPGTMYLGICMYQIITKHRWTC

SEQ ID NO: 784613 - protein, 108 aa, Homo sapiens
DLRHSSYADRLCLTFDELQQSGHHQYTAVYPQNLTHATLPACTCPRPPLHCFAITWMDLASPSLPTVGACALYCAIVTSLSAPTPAAKPPLLVQTHTSTSQSWCECIH

SEQ ID NO: 784614 - protein, 122 aa, Homo sapiens
DWLALGWVPPPGSIYHGWGVGAQVPSRATCGEKWPGWVSLSRGSGQACVLRADMVGSGTWQSVRRPGFFLSKNRAFKSSVNTAHCASHFPCEKNHRKAQLHLHEKPRKPSHFPQVWFSQKCI

SEQ ID NO: 784615 - protein, 182 aa, Homo sapiens
MMDISAPFFRDPPAPLGEPGKPFNELWDYEVVEAFFLNDITEQYLEVELCPHGQHLVLLLSGRRKCVETRTSFIVQSVQRRDKMGRQSLSPWSYFPPNVTKFNSFAIHGSKDKRSYEALYPVPQHELQQGQKPDFHCLEYFKSFNFNTLLEKSGTTGIRPGVIGECVFRGMGTYDHFPYTFR

SEQ ID NO: 784616 - protein, 213 aa, Homo sapiens
PSPVTSAEKKKPVFEKSFVRLQMDFKIEHTWDGFPVKHEPVFIRLNPGDRGVMMDISAPFFRDPPAPLGEPGKPFNELWDYEVVEAFFLNDITEQYLEVELCPHGQHLVLLLSGRRKCVETRTSFIVQSVQRRDKMGRQSLSPWSYFPPNVTKFNSFAIHGSKDKRSYEALYPVPQHELQQGQKPDFHCLEYFKSFNFNTLLEKSGTTGSDLG

SEQ ID NO: 784617 - protein, 1462 aa, Homo sapiens
SRTRAQAYRERDILAALSHPLVTGLLDQFETRKTLILILELCSSEELLDRLYRKGVVTEAEVKVYIQQLVEGLHYLHSHGVLHLDIKPSNILMVHPAREDIKICDFGFAQNITPAELQFSQYGSPEFVSPEIIQQNPVSESDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPDAQGCVPRPSVIRSLFYHQAGESPEHGALAYVSRRHPARRRHLLKGGYIAGALPGLREPLMEHRVLEEEAAREEQATLLAKAPSFETALRLPASGTHLAPGHSHSLEHDSPSTPRPSSEAAVRHSDCLTTPGGPYQGHGAPSGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMAPELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 784618 - protein, 70 aa, Homo sapiens
GKKIMTKSSKAIATKTKIDKWDLIKELLDSKRNHQQSKQTTYKIFTNDASNQGRISRICKEFKQLNKQKP

SEQ ID NO: 784619 - protein, 145 aa, Homo sapiens
RCASKGLSETATQMCRQTYTETDRDNPGKGADLRRQAPGEYPDPASPSPPSSSRGRCYPATAPSGTLGPDTGHHPLGSPSVPQCQDWEFGGLGHSPLQLWEAWWVWPHLCEHGGAARELKSALTAPLSNYQLIAPINTDGLAWLI

SEQ ID NO: 784620 - protein, 87 aa, Homo sapiens
MGCASPQEAPRLPHPSEERRACVCVEDWQLLQSALGPIWRRLCLPLNYTVMSRPGITAAPDGSWMPECSLSTGLQDRSERGAAEPAA

SEQ ID NO: 784621 - protein, 105 aa, Homo sapiens
HLQITARKKICLSFLKGTLALVLLLLIKQHLLTEKAANSKRTLSSVCQDSTSTAKASSNLALQWIPSQYQLLLNNPEKHSDPLPLSIDRINRKCLCVHKARKALN

SEQ ID NO: 784622 - protein, 103 aa, Homo sapiens
ERRWPPSSHALGNSPDSALCRPSLSDAPSADLQGGLNDVQDTTGVGDRKPPATALPSAFFSGPLGPGLSTAEGTGSGGTLLADASQALVWWVLEAPAGTPVAW

SEQ ID NO: 784623 - protein, 54 aa, Homo sapiens
KFDSNLDLTDLAWLSICWLLATFTIKSCAWPSACSAWLQHEMRIVGKLPQRLCG

SEQ ID NO: 784624 - protein, 201 aa, Homo sapiens
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGCWGAGEGAGQTPRRSCSWPAPSVTLEDWVQAIRRVIWAPLGGRDLWAALEETSPHERKYGPRLAPLLVEQCVDFIRERGLTEEGLFRMPGQA

SEQ ID NO: 784625 - protein, 128 aa, Homo sapiens
IQKKFAQTASFIMLPTASSKRRTFAARYFTRSKSLVMGEQSRSPGRMPCPHRLGPVLKAGWLKKQRSIMKNWQQRWFVLRGDQLFYYKDKDEIKPQVRSACPVCHGHRGRAPQEGRPCPGEGRKAQSH

SEQ ID NO: 784626 - protein, 54 aa, Homo sapiens
MPFTSGPHNLHPAQVDLASPNCASFISCKLLLKPAKRMSLLLLLHYCFDIAVVI

SEQ ID NO: 784627 - protein, 90 aa, Homo sapiens
MHTVASLLKLYLRELPEPVVPFARYEDFLSCAQLLTKDEGEGTLELAKQVSNLPQANYNLLRYICKFLDEVQAYSNVNKMSVQNLATVFG

SEQ ID NO: 784628 - protein, 64 aa, Homo sapiens
SDRTAPVCHALQCPLMSQASTEGLPRPLAESLGTCTIILPLQIRKLRQTTGRGRRGREFSSSSR

SEQ ID NO: 784629 - protein, 91 aa, Homo sapiens
PELRPNQELVTCALLNFRMQMDEKLLCLLFPLFSLRYCPPHLTQTKYLSHRSHPWVLTLLLCPRAGSFSWVLGLADFKNEAADLRSKCYSS

SEQ ID NO: 784630 - protein, 456 aa, Homo sapiens
MKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 784631 - protein, 456 aa, Homo sapiens; identical to SEQ ID NO: 784630

SEQ ID NO: 784632 - protein, 456 aa, Homo sapiens; identical to SEQ ID NO: 784630

SEQ ID NO: 784633 - protein, 456 aa, Homo sapiens; identical to SEQ ID NO: 784630

SEQ ID NO: 784634 - protein, 497 aa, Homo sapiens
MKIEEVKSTTKTQRIASHSHVKGLGLDESGLAKQAASGLVGQENAREVWPVDQGVGGCKQGCCGERAAEVGGSGRDARARGLPPLFPQACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 784635 - protein, 456 aa, Homo sapiens; identical to SEQ ID NO: 784630

SEQ ID NO: 784636 - protein, 456 aa, Homo sapiens; identical to SEQ ID NO: 784630

SEQ ID NO: 784637 - protein, 289 aa, Homo sapiens
MKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPAKGMRHTQKNSSRCDLEDWMWLCAGPRGNKKPSHRGRPKSKQQTPGHIRASNTGDNLPGKSGRGRRN

SEQ ID NO: 784638 - protein, 118 aa, Homo sapiens
MKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIIKTLSKEEETKK

SEQ ID NO: 784639 - protein, 127 aa, Homo sapiens
DQGACATPGPAHPSIPCNRQPPPLLTTTRYAYPVTRNPGCNQEKLPSESLSKPEQTWLDRPLTRLGAAAPVFCGPRPGEDQSFVLGDSCLSCFSTNAHAPLSHNEPLRPTTDPGICCRGWKGPTREA

SEQ ID NO: 784640 - protein, 113 aa, Homo sapiens
VLLNWIIQYYGYNVIQYYGGICVIININNTGEISGRQKSEMALTEFKSRCWEGSTPLGGCGGGSISLPSPTYGLCIPWLVAPSSIFKASSVASSHLPHIPLTLTCLPLTKTLA

SEQ ID NO: 784641 - protein, 152 aa, Homo sapiens
DGLSALPGTHLDGLSSLPGKLVPDPPRLPGLGQMQSTSNPSVPRARRSCGRPLMPPGWACGLWRGITTLSQCPGLSPHILALKSGSEILPLPLPAALFARRSWSPPRLHPTRVEWSWGVGPNSTGPVLFQGCPGAPSQLQPQVLPRLHSNPH

SEQ ID NO: 784642 - protein, 93 aa, Homo sapiens
VVLLSASMPGREKNDKSPACEGFSCDKEGPWGRVAGAAEAQEGSTHLEAQAATETVTCVSLGQPCHQEQLARDRDSQLVPRAQENQAQHIVWL

SEQ ID NO: 784643 - protein, 71 aa, Homo sapiens
WVGAGCGGRPAVGASGGHWTFPGWPVAWELHLVRCREVVTSTLSAGMAGALRLGDEVGWRCPGLPCLLLPK

SEQ ID NO: 784644 - protein, 121 aa, Homo sapiens
DHCWHTFRADISVCALALNKMHFFLSAFLSFLMNRLQPSVDRDSESQTVYCDAALETDGATCASVDGVGRSRLLLELSCMLCALVICFTPCRIQGHHLENYYWYSHWMAGTWKNECSFQGS

SEQ ID NO: 784645 - protein, 107 aa, Homo sapiens
DLLEEVRRRGGRQSRVDLLEEMRRRGGRQAVQGGPAGGGETSAGGRSSQQQRPRPGYRLRSLLGHGPDPRMAGGGLKRSWPWGGGFLAADCRGGPGLDPCWAEAAGH

SEQ ID NO: 784646 - protein, 125 aa, Homo sapiens
LAGTQLPRMEGKRREVQLVGVLFIIWYSLPVECSLPLHTHTHTHTHTHTQCTQMLHSDRVPDVSTIGSCLSLDSCSDPLLLALWALPVLSQTLKQSGMRIVKPAMSLGISGTSELRFSSTPAGEM

SEQ ID NO: 784647 - protein, 108 aa, Homo sapiens
CSGAISAHCNLRLLGSSSSTSASRVARITGVRHQAQLFFAFLVKTGFHYVGHDGLELLTSGDLPNSASQNSGITGVSHRAQPHTFSIYSHTEEFLPPSPHWDRIFLLF

SEQ ID NO: 784648 - protein, 61 aa, Homo sapiens
AVPCRCVPFITWQHFPGCKEGDPKMAWQSYHFELEFAGLNTREDDPILTVPEVCRGVPLAE

SEQ ID NO: 784649 - protein, 112 aa, Homo sapiens
HTPASCRGIPLLITACPGHWHCGDHVTERVRLGSYAPELVTRCVGVWMRLFVCGSPVPSVGVGGTTCEAGRGSGPESGGGRALIFARFPRSFPAPPAPEAGWKEGGRHLLGS

SEQ ID NO: 784650 - protein, 84 aa, Homo sapiens
EGVEGGRARVRDEKCLVYKNQSTSTGLNQKKDKRSCKNPHLEALRHRAITGEAECANKLSLRDLSALFHFSRLLCILLAIQPEK

SEQ ID NO: 784651 - protein, 102 aa, Homo sapiens
LPPLHTHTHGGCSICQQTCVEPTACWVDPGDAEVTLPCPLGDPTEGEGMWRGEGMDPSHRYRMEGMPCALETEAGEPRPGSWSGRALQNAPRASARTSHVGG

SEQ ID NO: 784652 - protein, 102 aa, Homo sapiens
VNTLPAPTAARAQEFKTSLGNIARCPISHSTLSGLHLCAHSHSFTPSHLISSHSGSFILVYTHSHTHTLPTHDHTHMLKHSHSSTLACSNAPTPPKALGFQV

SEQ ID NO: 784653 - protein, 531 aa, Homo sapiens
MASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASYGPYTRVQSMALPPGVVNSYNGLGGPPAAPPPPPHPHPHPHAHHLHAAAAPPPAPPHHGAAAPPPGQLSPASPATAAPPAPAPTSAPGLQFACARQPELAMMHCSYWDHDSKTGALQFAPRSLRAHRMPVQTDARMQGRATPAPVAADDAAASLTSHPLGPPLEPAPRVPLCFFAFLSSCRSSLSPQFMSSCAHLPDLCDLALPWPEAASLRAFYWARLFPEPQRLLPKFTAERARGGGATGRRQRRPLGLLSQVGALALRVPRPTAVQSMARRAGQD

SEQ ID NO: 784654 - protein, 129 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELGKIRKGRRR

SEQ ID NO: 784655 - protein, 129 aa, Homo sapiens; identical to SEQ ID NO: 784654

SEQ ID NO: 784656 - protein, 129 aa, Homo sapiens; identical to SEQ ID NO: 784654

SEQ ID NO: 784657 - protein, 104 aa, Homo sapiens
RDLQGPLRPQTTAHSSFPHSLLAKVSLRPSPDSRSDERASMSFGGQSCKVTGQRVWNLGDLSVPHSRVAAVGPRAASPGLKSRTAIAAPLPILVSLLRTTRLSL

SEQ ID NO: 784658 - protein, 570 aa, Homo sapiens
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPVTYSHFAQDLWPEQGIKDSFQEVILRRYGKCGHEDLQLRTGCKSVDECNLHKECYDELNQCLTTTQSEIFQYDKYVNVFYKFSNPNIQKIRHTGKKPFKCKKCDKSFCMLLHLTQHKRIHIRENSYQCEECGKVFNWFSTLTRHRRIHTGEKPYKCEQCGKAFKQSSTLTTHKIIHTGEKPYRCEECGKTFNRSSHLTTHKRIHTGEKPYRCEECGRAFNRSSHLTTHKIIHTGEKPYKCEECGKAFNQSSTLTTHKIIHAGEKPYKCEECGKAFYRFSYLTKHKIIHTGEKFYKCEECGKGFNWSSTLTKHKRIHTGEKPYKCEQCGKAFNESSNLTAHKIIHTGEKPYKCEECGKAFNRSPKLTAHKVIHSGEKPYKCEECGKAFNQFSNLTKHKITHIGDTSYKYLECDKAFSQSSTLTKHKVIHTGEKPYNCEEYGKAFNQSSNLIEQSNSYWRETLQM

SEQ ID NO: 784659 - protein, 133 aa, Homo sapiens
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPDGVSLLLPKLRLHSSLGHRARLHLKS

SEQ ID NO: 784660 - protein, 106 aa, Homo sapiens
RSPGDADVAGLGTLLFPSLLSAASPRKQQQWDAVRMSSCSPAHAAAPSVPLPLLGHAACGAPCFSTRPHTLTLQGVVPLSLSNSTDLFPAANTHAVISPIFRTQLS

SEQ ID NO: 784661 - protein, 62 aa, Homo sapiens
MQEEDFLRRTGNLTTRGLGMHSWRAEPGDEPRRVHCPTIGQPGAEPNRGRAHRDKRPELHKG

SEQ ID NO: 784662 - protein, 106 aa, Homo sapiens
RWSFALSPQLECNGGILAHYKPHLPGSSDSPTSASRVTGITGTHHHVRLIFVETRFHHVGQAGLELLISGDSPTPASQSARITGVNHRIRPNIIFLLRPYLAYLTL

SEQ ID NO: 784663 - protein, 281 aa, Homo sapiens
MSHGTYYECEPRGGQQPLEFSGGRAGPGELGDMCEHEASIDLSAYIESGEEQLLSDLFAVKPAPEARRLKGPGTPAFPHYLPPDPRPFAYPPHTFGPDRKALGPGIYSSPGSYDPRAVAVKEEPRGPEGSRAASRGSYNPLQYQVAHCGQTAMHLPPTLAAPGQPLRVLKAPLATAAPPCSPLLKAPSPAGPLHKGKKAVNKDSLEYRLRRERNNIAVRKSRDKAKRRILETQQKVLEYMAENERLRSRVEQLTQELDTLRNLFRQIPEAANLIKGVGGCS

SEQ ID NO: 784664 - protein, 92 aa, Homo sapiens
GAGPAGNCSFREETRVLFWVSWLGRSAKTGKWHYTMSIYASCRHQKEVHCHAKSLTKNSIKKHKSHNKKPTSHLVTRVGLKWWHLIISHDQF

SEQ ID NO: 784665 - protein, 114 aa, Homo sapiens
KRHVGLSFSGGSCIPAVSLFYLQPKDPCLGLFGPRQASQCFWKLSETDIYCLSPFTAFLPLGPQRELERDVSTFHSPHLYLQSDRIETAWPALAWELGMVKSQESARLARPPKG

SEQ ID NO: 784666 - protein, 130 aa, Homo sapiens
DSCRSLSGVEPQRIWCPDLPKSHRQHVLLAMGHSHGYGKLAWQGLFGWGVSPRAVLPSAREALAEVSEERQDAPRNLLAFRIPISCQCFPFLLPFSSPRLSVLVSCSVKSAPREDLGDGNNPQGLEGSSR

SEQ ID NO: 784667 - protein, 131 aa, Homo sapiens
AHAVAAQSSIMLQAVARAVLMDGEVGDIGGRVGGAHSVRHLHTAGQRLPGFLRAHPPLSARQGLVRGVQDVIHHLLRKGQALPQRLPLLQPREVDQVDLEPIQAARAERAALGELQQGPRHVAAQVVEVRR

SEQ ID NO: 784668 - protein, 293 aa, Homo sapiens
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRLQEFGQFRGFNKSVENLFLSLATHVKKLSKSQNDMTSEKHLLATGPRQCVGQTERRSQSDTAVNVTTRKVSAPDILKPLNQEDPKCSTNPILKQQNLPSSPAPSTIFSGGFRHVSLIPMLF

SEQ ID NO: 784669 - protein, 225 aa, Homo sapiens
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRNVKIKTGEWFYEERAKKFPTGGKHETVGGQLLQSYQKLSKISVVPPTPPPVSESQCSRSPGRKVSAPDILKPLNQEDPKCSTNPILKQQNLPSSPAPSTIFSGGFRHVSLIPMLF

SEQ ID NO: 784670 - protein, 293 aa, Homo sapiens; identical to SEQ ID NO: 784668

SEQ ID NO: 784671 - protein, 141 aa, Homo sapiens
MGIFLVLVRGTEKESETSLSSQTPALEEQRRMASSPEPQSSYLDHGHRERREGCWGTPILVFGMWSRVSYVPRGYTQGAGDPFLGRQPSPLQRPSLAQAAPRTPAFAAPSSPDRSPGAWEEASPAGQPELSGSHSLRAGVE

SEQ ID NO: 784672 - protein, 86 aa, Homo sapiens
SEAQKRSQGQRGKTERLGITLWKAMKMAAVIYRENVYREGRTLGRAPGCGSQLEEKAGQEVGGWMEAWIEHGPMNEWMQGFTYKRP

SEQ ID NO: 784673 - protein, 170 aa, Homo sapiens
MSRSSGCPSRSSCPGFQPPRSLQSLPSAQFSLHRGSNLSDPLGPPRSQGHRRLGRVRSAFFRDNLRSAHPWPPRPALLPRGCGGLRARLAGALLTVAHRPCAPASSPAVRGRSPGRARPGGWRQAAGGGGERWREGGGRRAGRSQRANKASSARDSPALSAFILSPALLF

SEQ ID NO: 784674 - protein, 35 aa, Homo sapiens
ISDVDYDSYRDPPCSGHSGLECRALIAGLGSHAVL

SEQ ID NO: 784675 - protein, 107 aa, Homo sapiens
LEDVLVERKILICWLKIDSSRSTAVVVNILTFCLYSCAALTSCITLSESFILFCLFLFWRWSLTLLPRLECGGVILAHCDLHLLGSSDPPASASRVAGITGTCHHPC

SEQ ID NO: 784676 - protein, 63 aa, Homo sapiens
LQLLDPIQSGSSLCSSTPPAPGPGGSRLTSLPLPQPAGYELSGPCSVLVSVHGSPAAGGPKGS

SEQ ID NO: 784677 - protein, 58 aa, Homo sapiens
CGMNGQKYEPACVVGTLLIVVGYDFGTRCKMREWRLAWMCTNKTIGKYEREAESHRGQ

SEQ ID NO: 784678 - protein, 148 aa, Homo sapiens
LNLPGSIDCTLACPVPGTTAMRHHTQLIFVFLVEMGFCHIGQADLELLAPNDSPISASQSCGITGAKITFRKCFLTILLNYFFIIFIGADSLRQAIRFNAADYSPGGSSSSNHILYATDRRFLSSTVSSTSIPATFFIDSTIPSYRSA

SEQ ID NO: 784679 - protein, 184 aa, Homo sapiens
RRSAQTARGFVFVGCVSVSAGASEALAPQPHTPELRVARADFSSEAHNRGRPPCRGSGQSQLFPAPGSLSRVPPDSMPPRGAAGATRALAPQSLCAGGGAGRPAPGAWAAAQRPKMRERRGREAGQAPHSRRPARGKKVEKAVWGQTLGSEKPRFRGRTRGGRTHGVQGTLFAAPARRAVGARP

SEQ ID NO: 784680 - protein, 138 aa, Homo sapiens
MPTEVALLHVSQSPTKAATRRPAHPECGAPIPTQPAAPTEERRGDPAPPSPQPARSPPLRQCLRQGLRVLLATPKERLVPRRVAAALPPLCAGKRQSLPEPRPEATRGSPGRGAGPGVRFPRRSRAVPRGCGTVGRAA

SEQ ID NO: 784681 - protein, 103 aa, Homo sapiens
DTHMQPLLHSHSGPPCDNTGCPSVSGSAPFTLMCCLDGDCMITVIMRGPQALGVLSPLELICPYICCPGPRHPTDHIQAPCSGPTGLWWTWGGARLLTLKGQR

SEQ ID NO: 784682 - protein, 105 aa, Homo sapiens
VPVLWCTVSWCTVSWCTVSWCSSLQSTQTHSLHSYQQVDFRRKSKCISPCTHYSTDPLSLAVTYAPYYSKQSPPRQPHDTCLQTSKDFIASDTFLFLISTPPPPT

SEQ ID NO: 784683 - protein, 37 aa, Homo sapiens
TRFTTFCRSCPLLRSSPQCSFFFPPVQAKAGLEVPTT

SEQ ID NO: 784684 - protein, 64 aa, Homo sapiens
MPKLYSQCHGEAPSGPVKRGRLSLTNKSDQLSVIKAKCQRRKSNGCRGREVTILEMNTSKTKKH

SEQ ID NO: 784685 - protein, 57 aa, Homo sapiens
KRGSPEAEVRGPHENRGTPGAQRWGQHVLGVSTKASGSSEFSLSKLLLIHSLIHSAK

SEQ ID NO: 784686 - protein, 196 aa, Homo sapiens
VFPFSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 784687 - protein, 93 aa, Homo sapiens
ASGWENLASIVIMHGISCVPVAEEAVIENRALWMMIKRCFGYQSKSQYRIWQRDLANDPSWPPLNQTSHSDMPECGRGVSYSNPVFESNEEQL

SEQ ID NO: 784688 - protein, 127 aa, Homo sapiens
VFPFSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEL

SEQ ID NO: 784689 - protein, 45 aa, Homo sapiens
DNRCGLAEVGHHSFVAAMKELKPAFTAGFFAPELVKNVMLLFGRA

SEQ ID NO: 784690 - protein, 41 aa, Homo sapiens
RGIQCLWSHEGKPQVSLTTLATADGPRNGLWGQRGSPSREF

SEQ ID NO: 784691 - protein, 71 aa, Homo sapiens
VPGITSHKRNKSKTHKPASTYTWLLKRTRVNGTCPSVLEEENRNPSNQPINQTKNKFHNESTYFVFLHFGV

SEQ ID NO: 784692 - protein, 177 aa, Homo sapiens
PFQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELC

SEQ ID NO: 784693 - protein, 96 aa, Homo sapiens
GSRAEQQGEPVFREWAEQQEPGERKENLASWGHRSQGRAASGEIRGVRVEEHHKNAEDAKALSCWVTSESIRVMGGAVSLQWMKEDGREDSRTLGV

SEQ ID NO: 784694 - protein, 156 aa, Homo sapiens
MFLSLCVQPTLKERVLRAHNYKQMSMNLTFCHSPYSTFTQVKANYILTSIPQFSASSTTLGRSEESTTVHSSPVATATTPSPARSTTSGLVEESTTYHSSPGSTQTMHFSLKATQLQAVVKNQQLPTAAQHNTISSAPKHISLVEELPATQQPGLK

SEQ ID NO: 784695 - protein, 128 aa, Homo sapiens
MFLFPCKAVRVRGPCMARGWPSCCLPTLGCDCLVPRPLWGCGRLTPHPLGGVAILLPAHWGMAILFPALWGVAILPPAHWGMATCSPPTGVDHPAPCPLGLAILLPAHRGCGHPAPCPLGLAILFPTH

SEQ ID NO: 784696 - protein, 44 aa, Homo sapiens
LQLENLHNHSMDLHIHHDSYGNHNHNNHNNLHIHNNLEDIHNHL

SEQ ID NO: 784697 - protein, 108 aa, Homo sapiens
PPPWGEPRSERPPPRTKCWALGLSERDVPKGGNRIGCQETLQSACPYELETKLSKVSTHTCTLAHAYTYGQPHAAATPTVHAHTLCVKAHLGSRPQRPAGCLQTKGGR

SEQ ID NO: 784698 - protein, 89 aa, Homo sapiens
MGAQHPQTERSDLQTLPGAMPSTWQLADLDSPFLIFLAVPPPGRLVLHLCWSCWAELASDVLYLVWGPLASSGNLASPDLPSTCHIDSL

SEQ ID NO: 784699 - protein, 109 aa, Homo sapiens
SVMEPERAWTPDHPQPLLSTSFSSADLSRGCVHICSPLPLLPLGPPAPTLPSCPPPSQTLPSQPRGESSLHLPHQDPAGAVRYWPLSQHHQALRPQTHAPVLRFLAGFP

SEQ ID NO: 784700 - protein, 131 aa, Homo sapiens
PSPSPSKVTQPITITIQSHQPLHHHYHQALHHHPKSPRPMTITIQSLPDPSSSPFEVTQTHHHHHPKSPSPSPSLSKVTSPFTITIQSHPDPSPSPPKVTQPLHHLHPKSPNLSPSAHHWLPPLSVRLSLK

SEQ ID NO: 784701 - protein, 69 aa, Homo sapiens
EMRMPETSLTEPPQRKGTPQSSREWEELLTRLGPRDPVQQQQQQAEPRRAERMPAVSAQFGEHLDQVEW

SEQ ID NO: 784702 - protein, 88 aa, Homo sapiens
MMIGYKDSLLVMVSENWKMESSSVAQAGVYGTISAHCNLRLPGSSDSFASASQVAGSTGAQHHAYANFCIIEMGFHCVNQNGLDLLTS

SEQ ID NO: 784703 - protein, 95 aa, Homo sapiens
DPAFLLGLHPTSTQKRVHDVHGSINLTVKGGNNPDVHQLMKRMDKTWRVVHLHSRTRLCHRKEGGTPQATTQRNSAEEFGRQRSHVVGSTVRKCL

SEQ ID NO: 784704 - protein, 75 aa, Homo sapiens
EMTVGAEMTAIKRAEQRRRGRGMMQALSFLKEEQLLSEFAEMGELEELGELADTVTKGLHPRGSWLLPFPWNDGH

SEQ ID NO: 784705 - protein, 106 aa, Homo sapiens
INLHERRDPNPGSRSQSLCSYLPNFPSHQLHSIANKLLVLVLRQVCFFSDQWRLPSAQTSAKKGDGTTELEIRLCTMKWLRHGDKGGVLTVSDKSTHWARRSGSAL

SEQ ID NO: 784706 - protein, 88 aa, Homo sapiens
NEPAGTQRVVGFPVLRESFNIPVAGGEAGPTVSPSRQGWRAGVLSVPHTQASPGSVSTWGLPKALSPKLSHSKLRTLQGGGCGPGDGM

SEQ ID NO: 784707 - protein, 87 aa, Homo sapiens
MPLRAPHWPLLLTSWVFCYNCSWLRLYDEEFMPLSSHKATHVAIMASPSWGAIEQQACLGEILAGMAVGTVQSSCGSAALLVASTHS

SEQ ID NO: 784708 - protein, 66 aa, Homo sapiens
QVVWAPFPLMVDRETAPETSSRDIPQVQRVRQAGALPPALDHWDPQPRARVTEPPPPHAAQRLIAA

SEQ ID NO: 784709 - protein, 66 aa, Homo sapiens
MPVTPAPGPRATRLAPFSPSASWPRGPESWEPEGVNEGQSCLGDSMLCFSPREANGAYHLQGLLQL

SEQ ID NO: 784710 - protein, 200 aa, Homo sapiens
SKECSIQSCLYQFTSMELLMGNNKLLCENCTKNKQKYQEETSFAEKKVEGVYTNARKQLLISAVPAVLILHLKRFHQAGLSLRKVNRHVDFPLMLDLAPFCSATCKNASVGDKVLYGLYGIVEHSGSMREGHYTAYVKVRTPSRKLSEHNTKKKNVPGLKAADSESAGQWVHVSDTYLQVVPESRALSAQAYLLFYERVL

SEQ ID NO: 784711 - protein, 60 aa, Homo sapiens
MEGRADLTSDSCCACIRDASRVHGELPAYAQPPRGLGSGICRREAWNITLPAFLTTEAAR

SEQ ID NO: 784712 - protein, 131 aa, Homo sapiens
VFKHRSYLMWHQQTHTGEKPYECSECGKAFCESAALIHHYVIHTGEKPFECLECGKAFRRSAAYLQHQRLHTGEKLYKCKECWKAFGCRSLFIVHQRIHTGEKPYKCEACGKGFTRNIDLHIHFRVHTGEK

SEQ ID NO: 784713 - protein, 96 aa, Homo sapiens
FSSLCQRLPDAAPLEAMKTKKKLNTQEMLPLICPGKDTDPVTLSPPQGAEHPSIWSHPASHDIQVIAQTRDRLGPGTLALATRLLLVLPAGTREAG

SEQ ID NO: 784714 - protein, 50 aa, Homo sapiens
MWLSQNYAGWFSCSSSGVWRVAWGVAGQHYCLSSCMPRVVFTLKSTPWSK

SEQ ID NO: 784715 - protein, 111 aa, Homo sapiens
MQSGTHWRVLGLCLLSVGVWGQDGNEEMGGITQTPYKVSISGTTVILTCPQYPGSEILWQHNDKNIGGDEDDKNIGSDEGSPVTEGIFRIGAKWLLCLLPQRKQTRRCGTF

SEQ ID NO: 784716 - protein, 78 aa, Homo sapiens
GAAGSTVMMQELARPHPGPCSRWCKPVWRLWEGLLIISITAVRTRTRSQVPTHTWCPHHPTEASSGAFHGTGQRNHDE

SEQ ID NO: 784717 - protein, 75 aa, Homo sapiens
EGNPVMCDNVDEPKVIMLSETTQAQKDRYCMSLICGSKTVTTHRNRVGQWLPGAGGMQTVAMLIKGVTSRHKVKF

SEQ ID NO: 784718 - protein, 37 aa, Homo sapiens
PSQHELPAKEPSDWEQIQNSFISLTDRTFLLNCGLKT

SEQ ID NO: 784719 - protein, 93 aa, Homo sapiens
MGSTFSQSAGALCLLPLVDLKAGPIVLLPDAHVPAIQDLQGELLSSHGILRTLSQILPILHSELSSGFSLRVETQIVITAHKALSLSLPPPPP

SEQ ID NO: 784720 - protein, 172 aa, Homo sapiens
EGPGAFPAGRGAPDCGAPWAGAQVSRASGAGRGRPGASALPAPALRCTPARGAGEGSAPPPGGCQGELGRRRGRPGTVRPHPPRQGALRRRGRHWLRALGAAAAGAAGGSRAGPFLLPLSFLSPPLPLARCRRHFPRFLLPLQSGGREGAAGAFLPACKLQRDSRLPSPPRP

SEQ ID NO: 784721 - protein, 146 aa, Homo sapiens
TLKPACAYLHSPLDCRWVPGLCIQKVPSECPMNKPHTNCLGVGHHRRHPLQGPGRGTGLVNVPYRVRGQVGAGLGSWSLRHHSSACRAIPGSKLEAGLSGTPASCHCTPVDGLTKALPELRTEETEQEKGQRASSQEAFQEESFGL

SEQ ID NO: 784722 - protein, 107 aa, Homo sapiens
EAQRRAVLDENHMGQSQEGATRPGSDGQGDADSPGHDDGVSERVADGHVTIVGHQHQQETFAVSKTQTEKGLRHAASKGDGLGWMQEVRQHLGHRVAGVGDVDDSQV

SEQ ID NO: 784723 - protein, 88 aa, Homo sapiens
MASCTNRGGLPEKHSSSKVSSHAQMIQKAVDFLDLLIGHLSKFSPVMIVFQFSPLGFLVRQSSADNVQFLSFAPSLILPSGTGNWLVW

SEQ ID NO: 784724 - protein, 109 aa, Homo sapiens
LGGGACSEPRSRHCTPAWATERDSISKKKKEKEKRKITTIILAYENACDVKITKSYQLFPKDCREMHPLLPTGISGCGIMHFSSCTFYLYFWIYYIIREGKAGHGGSRL

SEQ ID NO: 784725 - protein, 57 aa, Homo sapiens
MRDPAVTDGAVQPRYYTFPMVFANRRLGDSLGCLHHQGPGFQAQNWAAIWADTELAA

SEQ ID NO: 784726 - protein, 143 aa, Homo sapiens
DKALGASQEGLSPLPVPELGLGSERSKDLPSLRAKRESAHRWGEGAGWGWGAWECDTASSPFLTYGPLPTQAFPTSAPSLGRCRRSTGWGGLSHHMEHRHSPQPLPAALTAPAEEGHRGLYSHLGESETRVVPPVPAGGERAG

SEQ ID NO: 784727 - protein, 85 aa, Homo sapiens
GSHRQAPNGSILHQTPAPMWEAHLSAQGGGSAQCVWEEGGDTGNTVAAAPLASKPGSLITSHGTLTFLVCFLICERGSNSPCLLM

SEQ ID NO: 784728 - protein, 154 aa, Homo sapiens
SSSESLVNIRTEGNNGLGYFYHKFSDLYKDTSSHLLQAGTKVISQARLVGNLCAPRGLPSQVTTFVRSLPFLKHLAPHMPLKTDMQSTESHSPEARVGSSESEAAGSLRPAEGAAPYRASVFAATGLPGSSPSSVFRLEYEDARKSSAFKQSLV

SEQ ID NO: 784729 - protein, 72 aa, Homo sapiens
ITIIDIAVITITIFNITITIMIYLGAQEGVSSHLEESTLMMRFGIFTEQENIISSSRHARDIDHQRTECFLF

SEQ ID NO: 784730 - protein, 60 aa, Homo sapiens
SCPVCIDSEDPSRGMHTTGKGAHTRPDAAAQAQRGSEAQPATDLTWAWVSLVLVKISPTA

SEQ ID NO: 784731 - protein, 99 aa, Homo sapiens
LYSAQTPHIPATAAPQSLSTHMLSTKHVLVAIPRTIRAWPSSGKKKYTFFPEYYPTNTLCLDHRSQTLQQNRRNLHTPYLINWEKSITQVFLRVHGRCM

SEQ ID NO: 784732 - protein, 92 aa, Homo sapiens
MGAGDSASAWDDNPGSSSRPESKRLRREVWVFGGGTLGGKGSKGRRRSVTPPGPSAGEAPSDAAGIPRGAAGWPSSRVLPPSQAGPGPAPRA

SEQ ID NO: 784733 - protein, 118 aa, Homo sapiens
CQIPSGPYLKATADCVCSDSTVWPCMQVLPSTLFSHSLSWGSRHSTSTSKEATLFHTSTHFAYAHARFFHLPTCFWKLFFASLLLQSILAQASSLASECRVLQGDADHAGDSSFLCQS

SEQ ID NO: 784734 - protein, 108 aa, Homo sapiens
PRRRSCQGWSLGHVVTFPQQQSRSGIQSESGRAQICSVVWLPSLPWEEAIRCPVDAFPEASASLHLHSGGSAFDPSSAFSSTLPRRVQWSGPTSLQHLPGAAWPWTFV

SEQ ID NO: 784735 - protein, 114 aa, Homo sapiens
AHAHVHRHMHTHTCMHASVHTCTCTHIHAHTYMHTHAHRHTPAHRHTHAHTRMHTPCVHTCTHTYAHTMRPHMHTPTCTHIHAHTYRYTPAHRHMHPHTCTCTHIHALTQARIN

SEQ ID NO: 784736 - protein, 71 aa, Homo sapiens
SGETREIEATVNHDHIPLLDLNGTAACKSHLVDLRHDKARTIWSTLDMALLWLSPTLVAEIRLKKTKTIQQ

SEQ ID NO: 784737 - protein, 136 aa, Homo sapiens
MGSSVPTFPVPCSFLGRTEARPRKVRATLAGRSRTSATGRRRDTFFLWAKLPPPRSERQGASGPAQEAALFLTESRSCRCPPEGPTRLPLACRAPWRSRRPPALPLAPSSGARFSPKPLICSALSASRVTRRLARG

SEQ ID NO: 784738 - protein, 96 aa, Homo sapiens
MLASCPPFSTSESTRAALHGGPMRQPRPQRLALLLCPVPVKAQQALTGPSPLLTAPHSAPHPHCASSPCLAWATVPSCSDQSPGCLSLFPTSTLAP

SEQ ID NO: 784739 - protein, 62 aa, Homo sapiens
ITVPADVTPERVPTHIVDYSEHSIDKVTSRWIPLINERTDKDSRLPLILVWNKSDLVEYSSI

SEQ ID NO: 784740 - protein, 62 aa, Homo sapiens
MRPDQPPDTPPSYCLGYSSPLLCSCLLAPLCWLWLLYPRPPSGSLFPKVGCNKSQTQRLTNH

SEQ ID NO: 784741 - protein, 75 aa, Homo sapiens
NGSRRHWGRPNGSHLCCWNSSYQTTFHVCGRSASIGISSEGTAMACRIAGVFFDPRCFIRFLLCVFCDLAAWDCF

SEQ ID NO: 784742 - protein, 105 aa, Homo sapiens
PGLHPQCSSPSPQVEGGEGQGEHPFYCIHVQEIECPLPSTFKESAPGLSPGSVPRVELPREGWSAWSQSTLSPEPLDIHPEHQTYSVTLSSAVAFKKKFFSFSKT

SEQ ID NO: 784743 - protein, 166 aa, Homo sapiens
GATSPPRGGPSTPSTSVAGGVDPLGLPIQQTEAGADLQPDTEDPTLVGPPLHTPETEESKTQSSGDMGLPPASKSWSWATLEVPVPTGQPERVSRGKGSPKRSQHLGPSDIYLDDLPSLDSENAALYFPQSDSGLGARRWSEPSSQKSLRDPNPEHEPEPTLDTVD

SEQ ID NO: 784744 - protein, 81 aa, Homo sapiens
RQGAPCSLLRRVSVEPTLRQGAPWGHTHVCILSSETTIIRANVCWYLHTLCMISFIFTDEETEATWRLRNSPRVSLSSPCR

SEQ ID NO: 784745 - protein, 100 aa, Homo sapiens
MEELGLAWLLLMLACVCMPVCVCVCVCVCVCVSEWEEALSSSSLFSVSSLLSSHFFLMAQVTAPPPGCHAVIFHYHLYLFQIVKRGQKFFSFLGAVTKHI

SEQ ID NO: 784746 - protein, 90 aa, Homo sapiens
NTQWQIRDIDTNLPVEVACKYLKGNGFEGPLVEPPAKGRKRVEKCPGKDVPQSPFMGHPVLSLVQDCQAPPPFPEHPHFPAAEARSSAGH

SEQ ID NO: 784747 - protein, 83 aa, Homo sapiens
RTRPTTHCTSSRSVRGRVCGAGTRQKCGPKQHPWEPLGIMLWPAKPLRQRQQLWLPSSWTPCCLERQLFLPPFHGHFPSYDTG

SEQ ID NO: 784748 - protein, 58 aa, Homo sapiens
MNLNRNPGHQALRGFLVGEHMAMAGELAPWPHWEGYGSAVFPGPTGRGMEALCPWAPW

SEQ ID NO: 784749 - protein, 33 aa, Homo sapiens
CQAFIFCHLLPLYNAEKFVVCTHAGLVPASVPV

SEQ ID NO: 784750 - protein, 84 aa, Homo sapiens
EDSNIEARILDSSLYHISHTEPSEKSCVVLSSEYPEPEHFSSPSSSSLSSFVWILANVLPTLPTLQSHPHGTLTISAWPPWASM

SEQ ID NO: 784751 - protein, 146 aa, Homo sapiens
RRPGTAAGWLLAHSTVMETLGALLVLEFLLLSPVEAQQATEHRLKPWLVGLAAVVGFLFIVYLVLLANRLWCSKARAEDEEETTFRMESNLYQDQSEDKREKKEAKEKEEKRKKEKKTAKEGESNLGLDLEEKEPGDHERAKSTVM

SEQ ID NO: 784752 - protein, 146 aa, Homo sapiens; identical to SEQ ID NO: 784751

SEQ ID NO: 784753 - protein, 146 aa, Homo sapiens; identical to SEQ ID NO: 784751

SEQ ID NO: 784754 - protein, 108 aa, Homo sapiens
VCVCVCVCFNVFYPYPLIYTLVVSTLAIMTNAAMNKRVQISLQRVVSLPLSRYPEKGLLGHTVILFLIPIGTSVLFFTVAAPIYIPTNNAQRLPFVHILVNTYYPLSF

SEQ ID NO: 784755 - protein, 69 aa, Homo sapiens
FHFTSLSVYSSTASTAHRCRFAHIEKVLFQLQDPPFLKSLSLHLFGSHVLTAAWCSPNLHGINLKLRDN

SEQ ID NO: 784756 - protein, 628 aa, Homo sapiens
YSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 784757 - protein, 628 aa, Homo sapiens; identical to SEQ ID NO: 784756

SEQ ID NO: 784758 - protein, 99 aa, Homo sapiens
YSHLPRRKRMSVAHMSLQAAAALLKGRSVLDATGQRCRVVKRSFAFPSFLEEDVVDGADTFDFSSYLCPVSPSIRLSDGTLWERLWPWSGGREQGGRHK

SEQ ID NO: 784759 - protein, 88 aa, Homo sapiens
RFRLRTALSVGAEPQELWNEDDVKLREELGPPLRHAYRKVPFSRIPGGPGSRSICRYWERRRTRKPSAKGRVGGGDWRSGRGTRGGVT

SEQ ID NO: 784760 - protein, 76 aa, Homo sapiens
MGEPLGPISEGPLREDPGPGDKAAGGSHNIKKRAGGENRRRFLEQSQEGRSGGPSRGFLSPGSSGETEKFKLTAGC

SEQ ID NO: 784761 - protein, 43 aa, Homo sapiens
GKVKMFALLIGFLTDTGSEISVCQNMSCTSCDYTGSQVQIHTP

SEQ ID NO: 784762 - protein, 148 aa, Homo sapiens
LNIHRNQTATSAEHFTGKKNSPHEGKLIWWKDNKNKTWEIGKVITWGRGFACVSPGENQLPVWIPTRHLKFYNEPIRDANENASAETENPQSSIIDSQGEQNGDIRRTNEVTIHQENGTCGEPGRRIERKRDRDQRQTQKVRLGREIV

SEQ ID NO: 784763 - protein, 59 aa, Homo sapiens
KSESAKECVTTHLPNQLALKMDGAGASGPYPAVAGSREWTGAAGAARSARVWCASEGGG

SEQ ID NO: 784764 - protein, 451 aa, Homo sapiens
MHGYFGCNAAAEPGYSAFVGTPQICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 784765 - protein, 514 aa, Homo sapiens
CASLPGPPRRWWRRRRRFPRGARPRRCLSCAWTSLGKLSGLRVAQMCDLIEPQPAEKIGKMKKLRRTLSESFSRIALKKDDTTFDEICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 784766 - protein, 514 aa, Homo sapiens; identical to SEQ ID NO: 784765

SEQ ID NO: 784767 - protein, 361 aa, Homo sapiens
NSPGFLIRVPPAPSLPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 784768 - protein, 340 aa, Homo sapiens
MLALTLRPPPLAKSHLKLGGTPAPARVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 784769 - protein, 448 aa, Homo sapiens
MSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDNRFSGVWGPGRGEGPKRSYRQLPPSAWGTGVRASGRTETLGQRRSVRDCSDCQAGKGATDRGR

SEQ ID NO: 784770 - protein, 423 aa, Homo sapiens
MSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 784771 - protein, 108 aa, Homo sapiens
MVVQYRRQLYSTGHDCTAQGTVTVQDTVVQYRTQLYSTGDGYTAQGTVVQYRAWLYSTGDSYTVQSTVVQYHPAGCQMTWMYHFPSLGGGYNWYRTWTFALFTKWSEN

SEQ ID NO: 784772 - protein, 149 aa, Homo sapiens
CAGDSCYSGFRSDHRHGSKGCRTRDPREANIGGDGSGTRSFAGLQAAPQVQAATGGPGSARGPGQAPARRREGEGKGTPGRSHLNSARRGEPPGSHAHAGPGAQARQVTPADARARPGGASLPPLPRPYLDAPRRAASSRLSAPAPRGR

SEQ ID NO: 784773 - protein, 93 aa, Homo sapiens
NPAPQPRTHLPTHLAPGPISAVLKPMPKLSCLGHFSTGHPEATTPHWPLLLYLLCWLFLLYGHLKDGCYTLNPEPSPSLPAVDAAANLVVVVD

SEQ ID NO: 784774 - protein, 55 aa, Homo sapiens
FSAHAFTFHHLPILWFWVTQSPSRDETFDERVEIAVPHHLEIHTPRSLSIGVGEN

SEQ ID NO: 784775 - protein, 139 aa, Homo sapiens
EEEEEEEEEPGSLERVEKSRKKKKKRNQNKEQTNRKNQNEKPDGRSRYGMKMCARMSRERDTRRRGRRRERRGSARGHVGRCAGQDRRWAQAGWEAAEEGGWGCAAPAVAQRGRAQGPLPETDAKGSAREAGGWREGPR

SEQ ID NO: 784776 - protein, 95 aa, Homo sapiens
KGKLELEMFPILLDGRPLQGFMDSEFGLMCPLQDGDPSTCNVKSCGIEKYLLTQRKYRGGRALWLTPVIPALWEAEAGRSRGQEIETIMANTVKH

SEQ ID NO: 784777 - protein, 77 aa, Homo sapiens
ALGCYGGWHLSALPGNTQSSGPIPALACGLSCDHQGLETQQGVAWVLAGHCQRPGLHEDLQGMLLPSVLSKARSWTF

SEQ ID NO: 784778 - protein, 195 aa, Homo sapiens
DVSVVENAPTGTELLMLRATDGDLGDNGTVRFSLQEAETDRRSFRLDPVSGRLSTISSLDREEQAFYSLLVLATDLGSPPQSSMARINVSLLDINDNSPVFYPVQYFAHIKENEPGGSYITTVSATDPDLGTNGTVKYSISAGDRSRFQVNAQSGVISTRMALDREEKTAYQLQIVATDGGNLQSPNQAIVTITV

SEQ ID NO: 784779 - protein, 107 aa, Homo sapiens
HCPLLFRCRDCPSPSEPPALWCFVAQPQFNHGTPQPPGSCGVGVQGTPRHEGWCSAKATWPRHLSLCKRIERGNILLRRENSEDFKMKLSLSGASFLRTVSRIHTRR

SEQ ID NO: 784780 - protein, 101 aa, Homo sapiens
ALPPIPGANKLILLCNCTMTCTGKSSFPGYKAPLGESFWFALALIFCFGDFACDNITPELWQPSYHHEETATGIKSQSSEDLEERTEPGSQGITETQINSK

SEQ ID NO: 784781 - protein, 79 aa, Homo sapiens
MKFMERKKEKTHSHEQSQLGGMLLLYFCFLNYVCVCVHVCVCACACACMCFEGEGGLIAENGLIHSVDAAANLVVVGGR

SEQ ID NO: 784782 - protein, 47 aa, Homo sapiens
YKPPGINVSGLSVLGFLQRLLATQTHQATDLSSTSTFLQQPQSDQAT

SEQ ID NO: 784783 - protein, 88 aa, Homo sapiens
PPPTSFILQVDGHPVALPFLQEPLLYVELRGHTVILHAQPGLQVRLQGESGWAACWELQSCLGLCICRGGGDASYLLAKKGKEWGTGV

SEQ ID NO: 784784 - protein, 144 aa, Homo sapiens
GSVQDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVCCGMGSPRWR

SEQ ID NO: 784785 - protein, 178 aa, Homo sapiens
GSVQDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVRLQGESGWAACWELQSCLGLCICRGGGDASYLLAKKGKEWGTGV

SEQ ID NO: 784786 - protein, 128 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISLFCCGVHNE

SEQ ID NO: 784787 - protein, 128 aa, Homo sapiens; identical to SEQ ID NO: 784786

SEQ ID NO: 784788 - protein, 101 aa, Homo sapiens
SGPSKTSRVLQNVAFSVQKEVEKNLKSCLDNVNVVSVDTARTLFNQVMEKEFEDGIINWGRIVTIFAFEGILIKKLLRQQIAPDVDTYKEISLFCCGVHNE

SEQ ID NO: 784789 - protein, 82 aa, Homo sapiens
MSPGPPAQGLQEKSGQAGVSSVLDRPMPPQVLLASDRPPCLPLDCSVHLCPRSLDRLVGREGGPGEREGEQRLQPDALSYEA

SEQ ID NO: 784790 - protein, 102 aa, Homo sapiens
MPGDQETMIWAAHSPAGSRAKSHQCPFRSGAPPLPRRDRLPAERAGTSTFSAEAPFPSIGSSAAAGPQPEAVRDPRESLPVSLSKEDGPWRSPPCPLSTQIC

SEQ ID NO: 784791 - protein, 44 aa, Homo sapiens
SVYLILHPTVIEQESVKVTRPITSLQKNYSCCISELSRSLCINF

SEQ ID NO: 784792 - protein, 60 aa, Homo sapiens
GTGQVLCSVSPPSKGGGVFSRTCTPLAEKSLWTQAACCPLRALGRHRLPCEGQPGTGPGC

SEQ ID NO: 784793 - protein, 92 aa, Homo sapiens
ARQNSLWTSQKSRPSGTFLPPSENVTEKHNYRKDLRQVFKTQEWASLENGIQGLGRRLRRLLQLLLIFTVSRYCFGSFQTLERVFMALLTPE

SEQ ID NO: 784794 - protein, 131 aa, Homo sapiens
AKGAGRKEQVRRDRRWGESRDPTRVEELRELRGRKRLGAREGPSPREIGCGKIEERQKVPNLDSLLQGTRKVKTKTQRCHYLGCYFRNRTCPLRTTFFFFFFFEMESCSIEQAGVQWRGLSSLEALPPGFK

SEQ ID NO: 784795 - protein, 136 aa, Homo sapiens
MAHTRPTKSKPEQTRQQHTPIDPAPPHYHQRRRKPNARAGQAQPPQNKTAERRDGRRKDGKKPERKRSTKRTQPEHRANRQKAREQEETATDPKDKTTTAPKPATGSRNQPRSKRHRGRRKRPKAPTTERDRAKEG

SEQ ID NO: 784796 - protein, 62 aa, Homo sapiens
CQCGDSSVTMSSYSFDFPGSWEVHVHNSFPSLGRAGPPQPGICVILKILASDSPTHSHPWFG

SEQ ID NO: 784797 - protein, 117 aa, Homo sapiens
GLQELAVVGWGWGRWGEDGTYLIPQARDLSLWRHLVSSWRGEHGRSVCFLLRSPIHRENRAIMGAHAASPPTNISMSPPFLSLPCHPEAEEGPFCSGLIWPPVPRWYPSQEPYNMAL

SEQ ID NO: 784798 - protein, 104 aa, Homo sapiens [sequence omitted]

SEQ ID NO: 784799 - protein, 148 aa, Homo sapiens
LGSDWSHLADAGTETGESLNESAAHSPRGRRTLGPASSRARSAGSCDSSSSSFLPLPSSGHPDPPLPTAIPSGGGGHFPETLRPLGRRSLEKESILSKAQSHTLSGSGLSAPWAGSPSGESHLVIPFVLLFSLPSRLARAATGAEGAA

SEQ ID NO: 784800 - protein, 72 aa, Homo sapiens
YNSLVHLVDLNTPEGRDDAGIAPGLREHSLIYQRLGHPPWGLQEDDLVLNLHSAGYEPVISTPFPPLTAETR

SEQ ID NO: 784801 - protein, 104 aa, Homo sapiens
MTEQRSAFRFRGVGATVNQQTGTQDRLWDCGEIGRQLMSGATSSVAPPAFRAQVGGVMGVPRLLLPLLPSARIRPSLYRVYELSSFSFNTSLHMGGCHRRGEYD

SEQ ID NO: 784802 - protein, 110 aa, Homo sapiens
RLSLEGQRCRLGERSGSGHAGFPVPLRYAHGDVFRREQQIFGVLVLLLPGEVARVTSINQGPERTCLNSPPMQGGEPGLGSRSQLLVSSGQCWCCPWHSHKTGQVGANVS

SEQ ID NO: 784803 - protein, 108 aa, Homo sapiens
LDFSTPNRWKTYNCAVWYLLPPCGRRRSYLWRTKTILDRSMLTGTFKVEQGIVASINIILRNQRVMSKVCVSFGNKTSINERSVHPEIQDQKQIELSCYYLKSVLVLF

SEQ ID NO: 784804 - protein, 125 aa, Homo sapiens
LPGWLCWMCGRQDAWLLDTSWGGCRALPTEHWRISPHFSKGLAIKVPWGTVARVIREFGVDSPFGLGPALKEPLQGTHSSASGVRRRLRGRCCTRREPLGDQGVSDPSGLSPSPFQLRGPHLYWA

SEQ ID NO: 784805 - protein, 142 aa, Homo sapiens
MGGYCMLAICSKEAFWWGKWEDPGTGLLAERVLSAPTAWLLGGGIVGTLRAVTSEGTELASGLRAMDSHSSGSIATDRMLGSDWRLGATRLTSEVISPLALDIPVPHLARVPSLIVFTVDSLALMRSSSATERWGWLARSGW

SEQ ID NO: 784806 - protein, 168 aa, Homo sapiens
MTRKVQNIIFHENYSSPGLHDDIALVQLAEEVSFTEYIRKICLPEAKMKLSENDNVVVTGWGTLYMNGSFPVILQEDFLKIIDNKICNASYAYSGFVTDTMLCAGFMSGEADACQNDSGGPLAYPDSRNIWHLVGIVSWGDGCGKKNKPGVYTRVTSYRNWITSKTGL

SEQ ID NO: 784807 - protein, 92 aa, Homo sapiens
SHTCSGKGTGVEAEAQFESKLCEVQACTPGLVPGSLGTPVSSSSPYCHLTSSATSCHMRSSHTGQVAGRVLHPLKSLTCPQLGFRSAWHHSY

SEQ ID NO: 784808 - protein, 125 aa, Homo sapiens
VRKCSSPSNTPILGVSLSPNINIAPGNQTLSVVLKAQVRKHRAIQLIPLLVGLGMATATGTGIDSLSTSLSYYYTLSKDFSDSLQEITKSILTLQSQTDFLFQKFPLNKNYKKIIQKKEQLDIFV

SEQ ID NO: 784809 - protein, 101 aa, Homo sapiens
EDEGGYTDICSPPRALHREWPLWPWLKCCKGVGLCNYQILQVTNPAMHFFLDRRQGLPEERKTLCTQLELFRVKAETCSIDSKLINCHGVVFSLFPPSTSD

SEQ ID NO: 784810 - protein, 36 aa, Homo sapiens
REQVQPSPGGAGSPLRCAGSGLGVPGFHLPGPEGQR

SEQ ID NO: 784811 - protein, 107 aa, Homo sapiens
QSDNRESYLAKCLRLFLLFQSRLLPHSVSKTLGREAESGSGRAFFSFTCSCRPRALTPLRPTSPDRTFHGSLLCIFPQLDSCLLSHSANLPRPCRHSGSQNQLGCQD

SEQ ID NO: 784812 - protein, 45 aa, Homo sapiens
MPAIPARWERGHRLPGPGLLPPGATQCDLERKRTGRDRQKLPTLP

SEQ ID NO: 784813 - protein, 91 aa, Homo sapiens
CWDYRREPLCQPRIFKKGVSLSRPHSSAGHLCAGQNCSTLLSSPVKAAERMSRLRPELYLGFSSLEVIMDFAKSDGAEIGPVCVKELEEVK

SEQ ID NO: 784814 - protein, 132 aa, Homo sapiens
LSGHVSGLLPPIRQYPMPWDSGGSGIPAFHLFFHLFVLFTLCTKKRGLYYHRLLFLNRNSGWAQWNTPVIPALWEAEAGGSPEVSSSRPAWPTWPNPVSTKNRKISWAWWCASVIPATQKSDAGELLKTQEV

SEQ ID NO: 784815 - protein, 88 aa, Homo sapiens
PTETSPTPHGLTNAEEELTLPSCTDSMLVCSERRLVFATPVASITIPQNSIHGQGIFLIFTMRTECLLNEEIKGVHSGGLVDSQSQGF

SEQ ID NO: 784816 - protein, 109 aa, Homo sapiens
MQDTGNIIIKQWLGCKATTMPTGRRRNPVSVFHGSSFLRFFPKALTITRLRILSPSMTIMWPSRTPPAVLHISEGLGNIHMAAVGSRHPQEKTKPYPRRKRWRPSQMQR

SEQ ID NO: 784817 - protein, 74 aa, Homo sapiens
IPYPPSLLFSVFMGTLIPQQYWSHSIFLSNHNRAYHCCLQAWQHHVWPPTLPNWTPLPLSSLEIDAVAIYATAA

SEQ ID NO: 784818 - protein, 195 aa, Homo sapiens
SIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPIRTPAMIGCSFVVNRKFFGEIGLLDPGMDV

SEQ ID NO: 784819 - protein, 252 aa, Homo sapiens
MLLLDLMSSPSPQLLVAAAQQTLGMGKRRSPPQAICLHLAGEVLAVARGLKPAVLYDCNCAGASELQSYLEELKGLGFLTFGLHILEIGENSLIVSPEHVCQHLEQVLLGTIAFVDVSSCQRHPSVCSLDQLQDLKALVAEIITHLQGLQRDLSLAVSYSRLHSSDWNLCTVFGILLGYPVPYTFHLNQGDDNCLALTPLRVFTARISWLLGQPPILLYSFSVPESLFPGLRDILNTWEKDLRTRFRTQNDF

SEQ ID NO: 784820 - protein, 72 aa, Homo sapiens
SRLREKAKLICNSSVHQSTLQSLNAVETLGLVPVTHSERARVKRCELCVLHVEIAFQQSPCPWSNSAFRARS

SEQ ID NO: 784821 - protein, 70 aa, Homo sapiens
RPLPLQIGNTDIPQSSRNPSSLCIHTHNRSFSYVPTSVRTPDSGIPGTLRNICVTNMASLLSGVGHNFNC

SEQ ID NO: 784822 - protein, 293 aa, Homo sapiens
GEDRGTAMAESSESFTMASSPASVGEAMILSPSSPGRSSRRTDALTSSPGRDLPPFEDESEGLLGTEGPLEEEEDGEELIGDGMERDYPRHPQSWTPYDGRGDLALDDEERRGAAGQLSMDRSHQRAIAASVTAHAWARATKQTATYTQTETSLPMRPADRTERRTPASPLAHSKAALAHEPPSREPPAERYPYQLRSRTPQRLESGLRQERPSSAPHPPGAPGLPSQLGRAASPQWRGGLSRPKLLCTLTDTARIVGPRGESGLPHGATPTARRQKYRNPHNTPCTTVAPHA

SEQ ID NO: 784823 - protein, 139 aa, Homo sapiens
MEFSPTGLSCRGRWEGPINSTPLPSLSSVPIENEDKRQDKAAGEQNVMVITNHSDSGACGLANAEGQDGLSCPLRYRQCWALQEVAPPCPSWERVERTHAPCRHAGSPQKGLSYTYLPISSLRFTHRYSHQCKEPGEEP

SEQ ID NO: 784824 - protein, 143 aa, Homo sapiens
ALTESLVQSSFTRDMGLQKPPSLIPGYTSNMQTPPGLSPPCLGQVTSHIYTHTRTRIHTPLWRAGHCPPVPIPETSMLAVWTQPLSARIPGTQVPSLRSHAEELPLLHSRPHQLVIFCDFLGNSRPLLSHGHSHDHGLPSMRL

SEQ ID NO: 784825 - protein, 108 aa, Homo sapiens
MGPKAGQSQSRTLKDRQMQNWEWTCRDGKLEKDGSMNMHVRVHRFGRAWWLTPVIPALWEAEAGRSPQVRNSRPAWPTRRHPVSTKNTKLVRHGGDACNPSYLGGQGR

SEQ ID NO: 784826 - protein, 61 aa, Homo sapiens
GTYIVREQVCGQWSLIMPLVFRLGVRQTNSAWKTSPADLLPQMECEVTIGPASKNRNLRLK

SEQ ID NO: 784827 - protein, 98 aa, Homo sapiens
MCSLMEPMRHHLHPTLWIKYREEWSPKKNGGAVARRRGGRCGPEKQQTPSAPTFLQSYCQVLASGMEEPFTLQDFTLAIWPLREAQTKLTPFPRASHI

SEQ ID NO: 784828 - protein, 429 aa, Homo sapiens
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDVYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPAN

SEQ ID NO: 784829 - protein, 162 aa, Homo sapiens [sequence omitted]

SEQ ID NO: 784830 - protein, 71 aa, Homo sapiens
KLRRGVLEPGATSVPARSRVGTTPEPTVHALAAAPTLSLIGMVDFTELYGVTRPTGLETILSLNNVIYNEF

SEQ ID NO: 784831 - protein, 76 aa, Homo sapiens
ARTFGGGRGGLSREVFLSNVLVLYGVGAMVMLRPASPCGISIPGALWAVSPRGISIPGALWAASPCGISIPGRAEA

SEQ ID NO: 784832 - protein, 126 aa, Homo sapiens
MQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQ

SEQ ID NO: 784833 - protein, 126 aa, Homo sapiens; identical to SEQ ID NO: 784832

SEQ ID NO: 784834 - protein, 148 aa, Homo sapiens
MAEAALVNTPQIPMVTEEFVKPSQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQ

SEQ ID NO: 784835 - protein, 77 aa, Homo sapiens
FAACERVRGLGVSGSLGPGQVTGAGNRWRWCPPAEELAWSRSERRPAICHRTHAGSRALPPAFPGPAPPKVPWPRQR

SEQ ID NO: 784836 - protein, 50 aa, Homo sapiens
RRGLSQERREFQLLPGWVLINTGPLLSLPVPCCIHIMSRYDSSTKANAPG

SEQ ID NO: 784837 - protein, 84 aa, Homo sapiens
FPFPKTSSERSTYPLADSTKREFQHCSIHRRVQLCELNAIITEKFLRRLLSRFYAKIYPFRTKATEWSKYPLADPTKRVFQTAE

SEQ ID NO: 784838 - protein, 38 aa, Homo sapiens
MEWSGVAGHVTGLEVQHYKHGAHIHNILKRRSWAVGWS

SEQ ID NO: 784839 - protein, 99 aa, Homo sapiens
LRGKGGHEGLTHGVERQNRKWATSWFPGEGFGQAGGPPGPTRDGDQKGGHWCLMLVKGSFHKSCSLKWLSVLHSLRTGMLMSPALGAIPQPSTQMLVTR

SEQ ID NO: 784840 - protein, 102 aa, Homo sapiens
EGRVYIFTDLVRRFIWGQNQVLWGEPTSGNRSSQAREKHPECQGGKGPRNPTLVNTIFFRYGIRQHNLTEDLPGCPGQWEKARWVSRSPGLNNIRVFPCFLD

SEQ ID NO: 784841 - protein, 112 aa, Homo sapiens
PHCGSRKRVTRAINLLVMAPPAASPDGGTGPTPEQVGPPRLDLRGRRCAASPDAGPGRARPPLPPHPPAPGPAAGFPKGFCSGLGCRGFDFFTTRLRRLFAWKSPAIKTKNK

SEQ ID NO: 784842 - protein, 73 aa, Homo sapiens
EICLGIKQRRPQSTTISAQEGLGNSSSCPGQVAPNAWSAWMWSEEAPLHHHLYTGRMAVAQAAEPGAWINKKF

SEQ ID NO: 784843 - protein, 102 aa, Homo sapiens
VRTCCLQVRGTSSTCGKFPDIPCHCPFSFVHLTVSIESPWNIQHLIDQKQTRSCPHGAPRPGKGRSWREQLYPTIPGPTHTLHLRGSRVFTIDSAWCINHLV

SEQ ID NO: 784844 - protein, 92 aa, Homo sapiens
GTRRDIPELPHTELEALAVEETLSQLCSELQMLNNPEKIAEQISKDLAWLTSHMMTLWTQFLDTVTLHSQVTTYLTQEHHTLRVSGQLLCIL

SEQ ID NO: 784845 - protein, 114 aa, Homo sapiens
EVFAKDSKGSALDAGRDPKHPALPETLCESGWASNTAPTAPPQPGWCLCGKDFKSSCQTPGREKERRLATMHGSCSFLMLLLPLLLLLVATTGPVGALTDEEKRLMVELHNLYR

SEQ ID NO: 784846 - protein, 118 aa, Homo sapiens
MGRQRPRGLDPRLCCQASRVKVGLIFRLVPGPFILSVSQSVIPTGPETFFFFETEFRSCCPDCSPQPPSPGFKRFSCLSLPSSWDYRHVPAHLANFCILSRDGVSPCWPGWSRIPDLK

SEQ ID NO: 784847 - protein, 72 aa, Homo sapiens
RTICANLVRTPDRIAHYSPELLDSSDLPASASRGARITGVSHCLAINFPILTEDYLELEMELSSWMWFNSST

SEQ ID NO: 784848 - protein, 65 aa, Homo sapiens
MVGHLAGHRPCPQEQTPRTTADAAAGLAAHGPDREGTEEGREKKQTKNQGGFPVLPRRVALERGH

SEQ ID NO: 784849 - protein, 149 aa, Homo sapiens
VRPLSLSPGQRAFCILRFLLWYTGRIRSHVGLENECKVLLSGSSSQQMGEPEERWCGKVVFPWSRVSQWLELSSLRPSQTRHSSTRLWPAGVLVPVGMLSTFSQYPAAGVFLLMFSCLCLGVFIGTAWGCGGPGWSWEMQHLGVKAGVP

SEQ ID NO: 784850 - protein, 130 aa, Homo sapiens
IQCGGFEEFFRYPLCSSPPSWAPTDLLGSPRPLSTAPFSSVSSAFFSSDDVILLSSGSPIISSACSHLPVSFCCEYLLFSVYCEHVLISSGISLWFLVGSSVSVDISVVFTRHFLDFLHIFLSFSEELKV

SEQ ID NO: 784851 - protein, 58 aa, Homo sapiens
FKKQKSSRHNDITGSKYLALQNHSPSCIQGRHGSLSQPSFPECEPSFRIQFYAAPWAT

SEQ ID NO: 784852 - protein, 104 aa, Homo sapiens
MGSYRLQRSPPNVSEVKGAAPSRAGRRFLQAGDGQAGCTKSMMHMRSICSQSLNHLMTSGTSLKFTAGFPISLCCPGWSAVAQSQLTATLTSQGSGDPPASAPR

SEQ ID NO: 784853 - protein, 75 aa, Homo sapiens
APPGLKFHALDSSLAAAARSPHLLGAGEETRWRVFCGISGGGGTSSFGGTSSCILWRTLTPHPTLEARNRLPLGT

SEQ ID NO: 784854 - protein, 47 aa, Homo sapiens
ALLNADGFHTLVQLTRCESGHCESGLCAVLCPQFWVHSAVCDSRVPE

SEQ ID NO: 784855 - protein, 89 aa, Homo sapiens
NLPFREPHYVLLPPLSSSSCFLYVGILRTPRPGTRLRKEINDTGRLPGGIIGTRTASSVGYHCWGEPELRPWMEQGTRGSHEAMQPEIR

SEQ ID NO: 784856 - protein, 34 aa, Homo sapiens
METSFCISHQYPQLYKPYTECVISPQVHHSSSNG

SEQ ID NO: 784857 - protein, 89 aa, Homo sapiens
GARKLVTPLQSPVSSGALRFDLSLLEHELRGWQLPPSPQWPSHWAHLRLSQAGLRDPQKPPLQSGSLVRRQWVSYDVRKCGVQGIGVSF

SEQ ID NO: 784858 - protein, 140 aa, Homo sapiens
MPAGEAWGGQWRGVIVNKERLVNPKPLPAEELSKPGALPQLGSTGGFCKQSCPGGAAREGWGQRRGRMDVAGVPGGSWGVRGAGRQGRQRREGGVAAVELLSCLGRPCCLLQELNDFLRERRGEPDCRREGEAETEKPQP

SEQ ID NO: 784859 - protein, 97 aa, Homo sapiens
MPIGVTPSGPVRPLDDAASDVGAPVGFLPVGDGTCWLLEAWLVFPLRRFCEAAGSFVAEPFFCIDISLDSGNGCFTSLSSEVLSPEISSGFLGPCEF

SEQ ID NO: 784860 - protein, 203 aa, Homo sapiens
MLRNGSIVTEFILVGFQQSSTSTRALLFALFLALYSLTMAMNGLIIFITSWTDPKLNSPMYFFLGHLSLLDVCFITTTIPQMLIHLVVRDHIVSFVCCMTQMYFVFCVGVAECILLAFMAYDRYVAICYPLNYVPIISQKVCVRLVGTAWFFGLINGIFLEYISFREPFRRDNHIESFFCEAPIVIGLSCGDPQFSLWAIFAD

SEQ ID NO: 784861 - protein, 108 aa, Homo sapiens
FCIFEEIVCHIAQAGLKLLGSSSLPAPASQVAGITDSCHHARPNFVFSVEMGFHHVSQAGLELLISGDLPATAFQSAGITDMSHCTRPNFYLEVDSVNKYKNKNNVFK

SEQ ID NO: 784862 - protein, 296 aa, Homo sapiens
IPIDEWTAEITVYSPQQIIKVYVGSHWYATTLQTLLKYPELLSNPQRVYWITYGQTLLIHGDGQMFRHILNFLRLGKLFLPSEFKEWPLFCQEVEEYHIPSLSEALAQCEAYKSWTQEKESENEEAFSIRRLHVVTEGPGSLVEFSRDTKETTAYMPVDFEDCSDRTPWNKAKGNLVRSNQMDEAEQYTRPIQVSLCRNAKRAGNPSTYSHCRGLCTNPGHWGSHPESPPKKKCTTINLTQKSETKDPPATPMQKLISLVREWDMVNCKQWEFQPLTATRSSPLEEATLQLPLGSE

SEQ ID NO: 784863 - protein, 196 aa, Homo sapiens
RGAVAAVTSGPARARTAGGGRRGPGPGMAMFRSLVASAQQRQPPAGPAGGDSGLEAQYTCPICLEVYHRPVAIGSCGHTFCGECLQPCLQVPSPLCPLCRLPFDPKKVDKATHVEKQLSSYKAPCRGCNKKVTLAKMRVHISSCLKVQEQMANCPKFVPVVPTSQPIPSGGKAWGPGQGPAWRAGQHVNILFCSWH

SEQ ID NO: 784864 - protein, 90 aa, Homo sapiens
LYPRPASNIPNRSTFACPYCGARNLDQQELVKHCVESHRSDPNRVVCPICSAMPWGDPSYKSANFLQHLLHRHKFSYDTFVALARCHLQS

SEQ ID NO: 784865 - protein, 235 aa, Homo sapiens [sequence omitted]

SEQ ID NO: 784866 - protein, 235 aa, Homo sapiens [sequence omitted]

SEQ ID NO: 784867 - protein, 390 aa, Homo sapiens
MSRGCPGLQSGAAEQAVVLGAWAPPVSPCSEFFSPGQPERIRTGHMQSGLPYPTAAPFSNLGLQMRLCLPGTLLGMCCIPRSPAALRQSWVPSLSPGGPQTPAILQPVALDSGCAVGGGWRPASTEASPACPSVTRSVCPQPGAFLSGLHLASSFFWSKYLNSCRRQRSPYLFPATLLQPGFCPRPDCPAVTCFWPWSSGCSVPEIVLAAEGTGSPCCWQHRRLLTVLWSWTPEVSASPGRPFQILRTALPSLPCLQVTLAKMRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 784868 - protein, 128 aa, Homo sapiens
MRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 784869 - protein, 154 aa, Homo sapiens
MFRSLVASAQQRQPPAGPAGGDSGLEAQYTCPICLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 784870 - protein, 196 aa, Homo sapiens; identical to SEQ ID NO: 784863

SEQ ID NO: 784871 - protein, 388 aa, Homo sapiens
MSRGCPGLQSGAAEQAVVLGAWAPPVSPCSEFFSPGQPERIRTGHMQSGLPYPTAAPFSNLGLQMRLCLPGTLLGMCCIPRSPAALRQSWVPSLSPGGPQTPAILQPVALDSGCAVGGGWRPASTEASPACPSVTRSVCPQPGAFLSGLHLASSFFWSKYLNSCRRQRSPYLFPATLLQPGFCPRPDCPAVTCFWPWSSGCSVPEIVLAAEGTGSPCCWQHRRLLTVLWSWTPEVSASPGRPFQILRTALPSLPCLLGDPGKDESAHFVLPEGPGADGQLPQVRPRGVCPGHPLCVWVLEVCTFLFDDQEEIPAPQPQAVAAPSRGGAGREGASSTQSPGLGPLSPSKLTVPRCGRGRHPSGGKAWGPGQGPAWRAGQHVNILFCSWH

SEQ ID NO: 784872 - protein, 235 aa, Homo sapiens [sequence omitted]

SEQ ID NO: 784873 - protein, 81 aa, Homo sapiens
PIEHIEVFWFALSELYHIKQEMSVSLAALLCSTHWPPLQQHSGEDRGSVFCQPPRTGRSNKALKACRNNTHTEPQGTWIEV

SEQ ID NO: 784874 - protein, 84 aa, Homo sapiens
SHCCVWGAAEHNHKCGSPDTGQLLGLQECADPCPHLFVSPELRIKGFLTTPDHTPHLLSLPLLMKQLSSFSCLMENICLQAPQK

SEQ ID NO: 784875 - protein, 69 aa, Homo sapiens
MVTGHLLAWLGDRKWLSSVLTGCVCHSPPCGHMELTIERETRQRGGVLRTEAQKARDQGLGASCVSVHC

SEQ ID NO: 784876 - protein, 66 aa, Homo sapiens
DRARTQFCFLKPVPASCQSSGSTPGVQGESGSPECICLLVPHCILTLTLSAAVSPAGCSTLKHGKI

SEQ ID NO: 784877 - protein, 1607 aa, Homo sapiens
LYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVS

SEQ ID NO: 784878 - protein, 306 aa, Homo sapiens
LYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGGFLFLLSIFIFFSMDVVFCLVL

SEQ ID NO: 784879 - protein, 672 aa, Homo sapiens
AASALGLALPGGAMAAQRAGRGSPEPGPRPPRPPGPAAGAVPAASVARPARAEISLMMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRYDPRCKQWIKVASMNQRRVDFYLASIEDMLVAIGGRNENGALSSVETYSPKTDSWSYVAGLPRFTYGHAGTIYKDFVYISGGHDYQIGPYRKNLLCYDHRTDVWEERRPMTTARGWHSMCSLGDSIYSIGGSDDNIESMERFDVLGVEAYSPQCNQWTRVAPLLHANSESGVAVWEGRIYILGGYSWENTAFSKTVQVYDREADKWSRGVDLPKAIAGGSACVCALEPRPEDKKKKGKGKRHQDRGQ

SEQ ID NO: 784880 - protein, 672 aa, Homo sapiens; identical to SEQ ID NO: 784879

SEQ ID NO: 784881 - protein, 436 aa, Homo sapiens
AASALGLALPGGAMAAQRAGRGSPEPGPRPPRPPGPAAGAVPAASVARPARAEISLMMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRYDPRCKQWIKV

SEQ ID NO: 784882 - protein, 465 aa, Homo sapiens
AASALGLALPGGAMAAQRAGRGSPEPGPRPPRPPGPAAGAVPAASVARPARAEISLMMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRYDPRCKQWIKVRLKPDYFFSLEDSLGFLNLALTFLTSLGP

SEQ ID NO: 784883 - protein, 546 aa, Homo sapiens
GGILKDPRMDYAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSLLPKEANCEGFIEEAVRYHNNLAAQPVMQTKRTALRTNQERLLFVGGEVSERCLELSDDTCYLDAKSEQWVKETPLPARRSHHCVAVLGGFIFIAGGSFSRDNGGDAASNLLYRYDPRCKQWIKVASMNQRRVDFYLASIEDMLVAIGGRNENGALSSVETYSPKTDSWSYVAGLPRFTYGHAGTIYKDFVYISGGHDYQIGPYRKNLLCYDHRTDVWEERRPMTTARGWHSMCSLGDSIYSIGGSDDNIESMERFDVLGVEAYSPQCNQWTRVAPLLHANSESGVAVWEGRIYILGGYSWENTAFSKTVQVYDREADKWSRGVDLPKAIAGGSACVCALEPRPEDKKKKGKGKRHQDRGQ

SEQ ID NO: 784884 - protein, 672 aa, Homo sapiens; identical to SEQ ID NO: 784879

SEQ ID NO: 784885 - protein, 420 aa, Homo sapiens
AASALGLALPGGAMAAQRAGRGSPEPGPRPPRPPGPAAGAVPAASVARPARAEISLMMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCSCCTPTASRAWQCGRAASTSWAATAGRTLPSPRPCRCTTARPTSGAGASTCPRPSLAGPPVSAPWSHGQRTRRRKAKARGTRTGASDPSCASWDHPHRHLPGLCRPAATS

SEQ ID NO: 784886 - protein, 112 aa, Homo sapiens
DSERVKLGSGPGGLTAKLSTSPPCPAISLLMTATVYRVFMGCPLPIFLNPHGPLRRQAVPRLGGGKPGTALSSPSVSARRPCRFTYGHAGTIYKDFVYISGGHDYQIGPYRK

SEQ ID NO: 784887 - protein, 201 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELSEFKGEDLTDRGQMAESFAEYRLAVKAMLSPMRVLSWQGALDRGTTRTSLFDPAGTLRFDHWRGGRN

SEQ ID NO: 784888 - protein, 111 aa, Homo sapiens
GCIQTSPFQGPAPPAPATPPRHTEHMWRKPVFILLKAGELEKEASLRRGEAKGIKLPTMAMFLDFEIQSGKARSGGTPVAIMTANTQGLEGEGRSGKRENLHAALLCSRPT

SEQ ID NO: 784889 - protein, 44 aa, Homo sapiens
MCAVADNASRSPLFPDPDTASCSSAKCPREARHRSVKPGVKDEA

SEQ ID NO: 784890 - protein, 116 aa, Homo sapiens [sequence omitted]

SEQ ID NO: 784891 - protein, 75 aa, Homo sapiens
VHGSSISNCKDVKATSVPIHGGLDKGNVVQIHHGILHSHKTRIKACPLQLEASILSNLTQEQKSKYQMFSLTSRS

SEQ ID NO: 784892 - protein, 117 aa, Homo sapiens
VQDGRAGETVGKRDSLLGFGSETVAGFARTGRGPAGVQFRVDVLGNGRRDRLSKKLRGAEGGRHELHPAQRQDRRARCARSQVCSRVGRVDARRGPGGLCLTFGFLLLEESCLLEII

SEQ ID NO: 784893 - protein, 108 aa, Homo sapiens
PGKSRIPGRDHRRYYHDHWRLEYLMDFNPARHGMVCMVCGSSLATLKLSTIKRHIRQKHPYSLHWSPREKEVISNSWDAHLGLGACGEAEGLGVQGAEEEEEEEEEEE

SEQ ID NO: 784894 - protein, 43 aa, Homo sapiens
FPTSFSALQDCQILVEHILLNAYYMPAMIHGLGDTAENELTGL

SEQ ID NO: 784895 - protein, 253 aa, Homo sapiens
SSFRGSLGGDFGRASGRGGITPVTVNQSLLSPLNLEVDPNIQAVCTQVKEQIKTLNNKFASFIDKVQFLQQQNKMLETKWRPLQRQKTAQSNMDNMFESYINKLLLAAVTLGQEKLKLEVELDNMQGLVEDFKNKYEDDIKKHTEMENEFVLIKKDMDEAYKNKVELESHLEGLTEEISFLRQLYEEEIRELQSQISDTSVVLSIDNSRSLDMNSIIAEVKAPYEEIANHNQAEAESMRSNMRSCRRWLGSMG

SEQ ID NO: 784896 - protein, 82 aa, Homo sapiens
RASRHQEQRHDVAILVAWARVGEGKWSEHEVAAEGAAVLGKAALGHIGRILSAKEPLKVFGQEEPLRPPPGGSSRVRCMRFI

SEQ ID NO: 784897 - protein, 108 aa, Homo sapiens
STVISSPVAFPKSKTKAQHVLLELSISGVQGWVGCKRPGQHSHFIPRPFPKSKARARHVLLEFYNLELRLQNNSHSTIRRLRGCHRVDGREQDHRDNPVGHATLFPRC

SEQ ID NO: 784898 - protein, 110 aa, Homo sapiens
KIKSVPQPEITPISHITTPQLEPLLTKKSKEQGKCFSGNYQHRKILSHIFSYCSNNLLQNKEGSQAKQQQAKEILIEMSLSLLNKKAITVIVIKVDGVLFLCVKLLFSHH

SEQ ID NO: 784899 - protein, 522 aa, Homo sapiens [sequence omitted]

SEQ ID NO: 784900 - protein, 559 aa, Homo sapiens
MPQTCDGTGQMHLGSNCCKNGQTLLQRTCHGVSCCGWWFQAARSILGKGPSAQSLAGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHEQHQFWPLHPDLEHQSCLEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHRAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 784901 - protein, 501 aa, Homo sapiens
MGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHRAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 784902 - protein, 188 aa, Homo sapiens
MVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784903 - protein, 89 aa, Homo sapiens
PIARQPRLARQEENKAGLLDLPDASVNGWSSDEEKAGGLDDEEEAELVPSEVLMHQAIHTIEFCLGCVSNTASYLRLWALSLAHAQLSG

SEQ ID NO: 784904 - protein, 132 aa, Homo sapiens
SFPSVKWDCPRRSLAGPPCREGFRLRQVGRGLAGTHLPLAPTVSFAAELSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784905 - protein, 614 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784906 - protein, 614 aa, Homo sapiens; identical to SEQ ID NO: 784905

SEQ ID NO: 784907 - protein, 640 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWRLRPGPQPGWGPRSTRSPDRPPLRCRSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784908 - protein, 630 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPDGEGAPESSPPLLPPWIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784909 - protein, 788 aa, Homo sapiens
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVKAEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784910 - protein, 428 aa, Homo sapiens [sequence omitted]

SEQ ID NO: 784911 - protein, 533 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSG

SEQ ID NO: 784912 - protein, 456 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSMHSAGSLHLVGPISALLTVLAFIHFSRSSPYAAPEWRGGANSPAGARNLENIL

SEQ ID NO: 784913 - protein, 326 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPVSPGMECPWVVKAAGSGGWGSPRF

SEQ ID NO: 784914 - protein, 162 aa, Homo sapiens
MPQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784915 - protein, 172 aa, Homo sapiens
TLEYPSHSPTDIDHSILLDFTEHVLYCYLLSLPSRVVTWQTSCGEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784916 - protein, 830 aa, Homo sapiens
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784917 - protein, 172 aa, Homo sapiens; identical to SEQ ID NO: 784915

SEQ ID NO: 784918 - protein, 819 aa, Homo sapiens
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITELLPLPRLPVSAAGGGPPRGPAAAATAEPGAAGGPRGDRAVPEPGARPGAAAAAARAGAGPQDEGRVPGPEPVQREHPVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784919 - protein, 628 aa, Homo sapiens
ESAEPALQGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784920 - protein, 456 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPELDARALRGAVTAEKKAGCD

SEQ ID NO: 784921 - protein, 600 aa, Homo sapiens
MTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQVGPGPKVWGAACGERPLSGVSLTPRFLTDLLSGQEQAWRVVGDLLGLECCQHCLLMPQEENKAGLLDLPDASVNGWSSDEEKAGGLDDEEEAELVPSEVLMHQAIHTIEFCLGCVSNTASYLRLWALSLAHAHAVRGSVGLVRGG

SEQ ID NO: 784922 - protein, 283 aa, Homo sapiens
RRSHQEEEDTHCDDDHWQQRASGSPLDYGLTQDKLCPDTHGNQSHCTGAKGQQEDVEQELHTFHSSFHRHGCRASRGRLARQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 784923 - protein, 91 aa, Homo sapiens
EVGVAAVVLVPIFAAFAVMTVAILLVMEGLSAFLHALRLHWERPPTGLGCSRREFPSPTPLLLTPRVEFQNKFYSGTGYKLSPFTFAATDD

SEQ ID NO: 784924 - protein, 110 aa, Homo sapiens
NTKPFVPFSLPSTFPNQNYFSYWTLPCKLVPLPEFSLSIEGHSHSNSKPVIFIFFPLYAMTIPVKKILNVSQVLPLLSLVPSYLPTCIHVIVKNLTSSFPGSILPFCQYG

SEQ ID NO: 784925 - protein, 129 aa, Homo sapiens
VKPDHPGLPAARIQLAKFSKNFPTLLEIFRSPHTPLLGYKFPLFFVVFGVGPLSPLYCKIHCDNSYIYRNSPDTVYLTSLTSVRIKFFFHQLPKSSWTHCSHPSLRVCKLLGLGLWLTSPNKPQKKTLS

SEQ ID NO: 784926 - protein, 139 aa, Homo sapiens
RIPDSYTYTQTQPQPYAVHGHYSSDDLKTPSERQLTPLPPSAPPSADDNIKIPAERLRIPLPPSADDNLKTPSERQLTPLPPSAPPSADDNIKTPAERLRGPLPPSADDNLKTPSERQLTPLPPSADDNLKTPSERQLT

SEQ ID NO: 784927 - protein, 98 aa, Homo sapiens
ARMLIERLRRKHRKRNPGYNCYLQVSDWSWNLTLPSWVSMPRVFVVHLPQKDLVPNISQISVIKVFTNTDPCKRPNYHLQQQCNGLPWPYSRAKSART

SEQ ID NO: 784928 - protein, 30 aa, Homo sapiens
MDLGGKGTRTGVRSPGGVHWLAVEAGPVTC

SEQ ID NO: 784929 - protein, 102 aa, Homo sapiens
KILNRNGHSGFTPAKAESQAPTTGEAILGKQRVGLGDSQENPTSGIKKNVLIVTIFTDELSIFQNSLPQNSAPICPGAPQYPKKTCTTVPTTYSSNLLVCLS

SEQ ID NO: 784930 - protein, 116 aa, Homo sapiens
MQVEVQSLSLEECPWRLPGPQCECEALLPSGARRRIDLRLSGRAVAVWVHVRGGPGQFNLSYATGRHKKPNPHQNMNRGMEFIAPVSAPTKSGAPWHFLSQGPTDAQRAVRIRPGT

SEQ ID NO: 784931 - protein, 96 aa, Homo sapiens
QDLPGRPLGPRTPRPPAHPRRVSLIPPDRDPRKREKRVFPTPFMGERKPRGAQEQRPQQDLHPEPQEQPQRPKLHPAKEQKTGPGTAETSLQSSFH

SEQ ID NO: 784932 - protein, 105 aa, Homo sapiens
RPDFPHLMCFFAATRKGNHGSEACQDPQGKLAAGSAAALSWGLLRPVRRNSGGFQSPKDILALKGFLLLKNALCAVCGSSYVLPQLFRKLGQKDCLRLGIQDWPG

SEQ ID NO: 784933 - protein, 104 aa, Homo sapiens
RSSTSLQISWWNLFLTVLVSILVTLRQTILCSHNTDLPTNGEPNKILCCYRTFLCHLHLLVLHHVEGNYTFIYYTSSNIKPRKLYQRQQLFNHPSRYTSFKRQS

SEQ ID NO: 784934 - protein, 35 aa, Homo sapiens
ERSVENDPENSGLSNCGWRCNMLKLGKLDEEQVWE

SEQ ID NO: 784935 - protein, 109 aa, Homo sapiens [sequence omitted]

SEQ ID NO: 784936 - protein, 182 aa, Homo sapiens
PRTGLPGLRPVPSIILQIILRKTSTFFAFFLNTNLPGVNSRRKHTQGFVLHTDFSPWSRERLLFLLNPPRPTPAIWGRGFLRRRRRCRRADSPGFRVARAGPRLAPLPVSVCPRRAAGARRPDKSSGRRAHGPRERSSPEAEGPGTTLRTQRQEVPAPAGSGCSRGSRHARGPRARAPGEGA

SEQ ID NO: 784937 - protein, 244 aa, Homo sapiens
LEAPETPSHELTDAPRSSLSAVPQVGGTGVGRAGSASAAESARTAWGWGSIPGTAGGEHSGNHLWAVWGGGASLEAGRGASMGAATSRRLPAVPGSRRPHGLLSAPWPTAVALVPPSSGGQLRASSALQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQT

SEQ ID NO: 784938 - protein, 117 aa, Homo sapiens
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQT

SEQ ID NO: 784939 - protein, 110 aa, Homo sapiens
MAGYGTSQPTITLQGRPRRAPPLPGEGSPIHAGAGWPRRRWTNLATAPWHHLTRGQLTPPQGSEERSCPGDGCVSLQLPGTCPLNTRCYVSQRKLVSTHPRPVLVLGTPP

SEQ ID NO: 784940 - protein, 131 aa, Homo sapiens
PTPAKGQHPHVSHQHRFGRASTEAAFLPSTFASVPALPWNLPSAPPVLPTSVPPVPSSSHHPFSSPKSGMIRSCLEDPPFLPCPLFVLSPGRSPDPALTKSRSQMPSGSTASIKGSPHFLCLRLCFPPPPS

SEQ ID NO: 784941 - protein, 169 aa, Homo sapiens
GQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLHLPPALVEEGGDLQNQHTELETRKEAMAVKVTLCPIKQTPACGKKTQPL

SEQ ID NO: 784942 - protein, 152 aa, Homo sapiens
MGSRSSHAAVIPDGDSIRRETGFSQASLLRLHHRFRALDRNKKGYLSRMDLQQIGALAVNPLGDRIIESFFPDGSQRVDFPGFVRVLAHFRPVEDEDTETQDPKKPEPLNSRRNKLHYAFQLYDLDRDGKISRHEKAGGFSPSEWFGGTRWE

SEQ ID NO: 784943 - protein, 190 aa, Homo sapiens
LQQNNFFLETQSPSVAQATVQWHNHELTATSASWAHASFQPDAPEYLALLCLANFFLYCFVETGFCHVAQAGLKLLSSNNPPTLASQVAGIKGVHHHAWLIFVFLVETGFHHDGQAGLEPLTSCDLSALASQTAGITGMSHHARALYSLLLLFVFKRQGLALLPRLKCSSAIVACCSLELLGSNDPPVSA

SEQ ID NO: 784944 - protein, 71 aa, Homo sapiens
AKGPWRPGPWLMLIYTEYTEVLSKCFSEWLLGGETWRQRQNSRQPLPHSLLLHPQGLGSVPQRVRLGEHVS

SEQ ID NO: 784945 - protein, 94 aa, Homo sapiens
PVGRLGPCLPSFTGSGESIRSRAKEKGSPKAPPRPSGDETAPWSQEHQVCRVNPEQLTTYQAKRKTTPRKTQGNSVTRTHSLQRQLFTPELSDN

SEQ ID NO: 784946 - protein, 44 aa, Homo sapiens
MLDRLLSLTKTVIFRTSKLSPRQLIPPTPSSAPRAADRQPCFAN

SEQ ID NO: 784947 - protein, 82 aa, Homo sapiens
DLLSLLAFIFLPCWMLPTLKHWTPSSSAFGLLDLHQWFARGSKAFGHILKAALQASLLLRFGTRTGFLAPQLADGLLWDFTL

SEQ ID NO: 784948 - protein, 253 aa, Homo sapiens
NKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRN

SEQ ID NO: 784949 - protein, 37 aa, Homo sapiens
LPPPLPSSHTALSRSLSYARLKKNRARNASIALPSAA

SEQ ID NO: 784950 - protein, 103 aa, Homo sapiens
PARASGAQPPLQRRALRFGRRNLQDTASRTPSASGNRQHRRRERPPPPRLLSRVLPVTSLRAGPGRGDISLLPRRLVGPTDGRSQRGPDCGTRPEQLNIRYPE

SEQ ID NO: 784951 - protein, 43 aa, Homo sapiens
RIVIFSWNSVNCILRTSAILMLEDSTTFVVLFPGRDSTTEVVL

SEQ ID NO: 784952 - protein, 114 aa, Homo sapiens
KLANGIDRDDVILLMMKLRHRRVKQLAQSHSNDQWQSQDSNSGFNPTPEPTFLTISRVSLRVNSPKTLGRCTAHSKRHRHNRASHLFKVHAHPWRSPSLPSSILLLPTTFTQIK

SEQ ID NO: 784953 - protein, 58 aa, Homo sapiens
QPMGAAVGHKPCKATGAGLPKAFRAQPSCPCALDVGQRFKKGDFGTVGLNDWPSGFGV

SEQ ID NO: 784954 - protein, 91 aa, Homo sapiens
MATPRGLGALLLLLLLPTSGQEKPTEGPRNTCLGSNNMYDIFNLNDKALCFTKCRQSGSDSCNVENLQRYWLNYEAHLMKEGLTQKVNTPF

SEQ ID NO: 784955 - protein, 163 aa, Homo sapiens
YSLGISIDNYVVSRYSFTSSFPVCPSFLFASLIILVKISSTVQPGVQGTDTLPGLHVRDAVRPPCIISAGFLQVSFSWLRKFSSLPSLLRTLNHKRVLDCYKWLCCSPTEMACTPFHSTETGDFPKRSKHPAFPDGLQPHAIFPTGLSVLLLLPLLCPRSCRG

SEQ ID NO: 784956 - protein, 53 aa, Homo sapiens
MGSSLTPSFPLASLYYSSSPSCARGLAEDDTYLKGCVLASTFLTRKSLPETDH

SEQ ID NO: 784957 - protein, 109 aa, Homo sapiens
SAESGSSRHEHCACKCPVMQTPPACESTVAFHLTKILTVCVPKIKARKSASPPVAMRGRPYRLSKTVDSKIKECCICSSRFSLSTFKLLAQLEKTILPLFLQGEKIRLE

SEQ ID NO: 784958 - protein, 89 aa, Homo sapiens
MKLSRALSDLVKYTKSVATHDIEMEAASSWQVSSFSETKAHQILQQKPAQYLRFNQQQLSRIYPSSYRVDSSNYNPQPFWNAGCQMGGC

SEQ ID NO: 784959 - protein, 120 aa, Homo sapiens
DGNQPLGSPDIGLSRQRLFKNSINREGPLQGELQTTAQGNKRVHKQMETHSMLMDRKNQYCENGYTTQSNLQIQCYSQQATDCLHRIRKNYLKFHMKPKTSPYSQDDTKQKEQRWRHNAT

SEQ ID NO: 784960 - protein, 107 aa, Homo sapiens
RGKRGAWAAPAGVLGGRPRGEPPCLPSGPQRPPLPRRVGEPGSGGRGGGGIRERGGEGAHLQGERGLTKGRRGRPEPGGALWSWPLGSLDPRCREAARSRGLRESLC

SEQ ID NO: 784961 - protein, 32 aa, Homo sapiens
MPTQHSLGGQDPLGQHSEMTELETSVPLPFRP

SEQ ID NO: 784962 - protein, 319 aa, Homo sapiens
DPACTPHKGDSTSQEIHSATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPS

SEQ ID NO: 784963 - protein, 47 aa, Homo sapiens
NINYCWNVSCSEGKWHDPLPALRLNGCWTTPAWCPAIPDLPLHLTLR

SEQ ID NO: 784964 - protein, 70 aa, Homo sapiens
STAPPLTHRPHLPLHLGVYLPFTPALSALWQTPRLPPGGFKHPSLPEALLLPQRLHPKKCHLQIDQEHLR

SEQ ID NO: 784965 - protein, 109 aa, Homo sapiens
NRKASRDSQLISLLIHFLWETVPEVNSEDVYVQLYLCTNIVNMVCKYRRIWMDIAEIKVHVGVANDDTFANLQAVMPHSSSLLTLTKLYRFFVLYALQVDLKSCSLMLS

SEQ ID NO: 784966 - protein, 2114 aa, Homo sapiens
MGEGRTGAGRAGLPLDQATPAVDQLLPPLPLACPPQSSQPEWALGTLSPETPPLIPPGTQTHPQKPCDLLGSAVGGMGSVPHAAVATKVIHTGPGAPRGAPLDHCLPPSPWHRLQSPMWGLGRGLLAAMPQQAGGLLRAGPLTTSPAIPSGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVSVTPCHQPSWGGATPAPCPMPPHVSPVLGPELRQLRPRVPSPGLCSSISRGAAVGAWLLSHQCPPLISGLALGISGRTGPECSGPCPALCHPCLSQTLGGLAASTPTVLPSGFSAGTERCPSPLYYPPPLYFLVSRGRQLPGFACDSTPSMSVPCPRSGWGLGFRRKWSWCQPCCPGFELGPSALWVLLAAAGPRGTRTHSRRGLPRPSADSLLPCSRAQRCHPAPAVYPPICSSSPRLQGSPRHCCGRLTCSPCLFGLAVGFSMATAYFRSAALLGALKVPGARDSAARRPCMPRPHPISIHDFLVAFGDCRSCDVDHDMAPGALAIPSHSGIYEADPGFSWVAAFSLASPPLPSLSPPSPPSVLPPLPQPLPWRAARWSPHCAPPIPLLLSPAPISDPQAVGSEFASHSLPVLANHASAWDEGTPEAGAPSQNPGSASKWLPSHCDQMRRFGILNQEADSSAGHLNASAQRRPCRGVTHLPGLGRSVHEHGSSWGRGGCCLGGIWHVRAPLASAPWRCGCLPLSSCSAQAGTSWAQLSRKIGCGQVLVGWESEPILAGLRGQQASCGPWGLTEWRAGQDQKRLPGGIQEGFLEEVVLPRARVSPWEWAGHGPGKWASRCTWLLLLWTSYSCLRVGHTQPGSATPVSPAERRGLRASEQVQAVVGQAGARGLSSGGKDLLSMPLKGPTCPGQVRRGQFLPEGWGGPCVLRSVAATVPGRAALGTLLLKALVCPHTPSLRWPSPSDRDTHGTSVARSGELALGEQLQLGWDPWQQLHGLLLLQVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAGKPLLPCVVLPHAPGMAGPGSPAAASAWTVSPRVLVLVALYPWHCLRGTLLPWLACGPSAPALLSELEALGLGWSWFEARQAGKNQLLLLRVWGRDCGLTCWAPPAGRFPKLTSWAAGDLHVPLMPFLGLGATYHPIPTSLKGRLQGSLLGSLMWAGSAAAGRLLRPWDAWSLLSAAWSRFPGPQGFAALGCSTPLEGCLLSLEGGTYTEPAPHHPAPPDPPDQAFLSAPTHAASVVRNWERRVTGNGAQPRCPVLSQPKEGPVCGTGRGLGPSSSRVGTPSVPRPGDASGWELGLATLGTGHRGHHPDPTPLRLFSLPPSLSSASPSGSLSLPHLPTDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPGMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 784967 - protein, 719 aa, Homo sapiens
ALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRVRNWERRVTDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPGMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 784968 - protein, 283 aa, Homo sapiens
ALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRVRN

SEQ ID NO: 784969 - protein, 719 aa, Homo sapiens; identical to SEQ ID NO: 784967

SEQ ID NO: 784970 - protein, 719 aa, Homo sapiens; identical to SEQ ID NO: 784967

SEQ ID NO: 784971 - protein, 450 aa, Homo sapiens
ALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAVRN

SEQ ID NO: 784972 - protein, 72 aa, Homo sapiens
SPYVEVAMDEVVLHTPRLHTLRETSIPFSCHPFSCHPLTSLISSISSPGKPRIYFVLVWICLFWTFHINRII

SEQ ID NO: 784973 - protein, 42 aa, Homo sapiens
NIGVLASKDQQARIVTILAEVIELDQQKKVGLYTLGMYVEEQ

SEQ ID NO: 784974 - protein, 126 aa, Homo sapiens
RQASSASLICVQGSLENGMIKTRGHKVSSFPFHREVTISPLVYLGGPRLSVKTPAFVGNGVMQHWNMAGRGDSASSRFPMWRPRLGDSGGLFKTTRFVGSIAPQSTSPLRWPRMGRRKSAEHVKYK

SEQ ID NO: 784975 - protein, 226 aa, Homo sapiens
MRKVVVITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFSTAKGGDLELFQIMPVTFECGFEQELQPAGFLFQCGLVQVQH

SEQ ID NO: 784976 - protein, 39 aa, Homo sapiens
CYTVVKRNEVLIHATTWMSLKIIMLSERRQSQKVTCCMI

SEQ ID NO: 784977 - protein, 163 aa, Homo sapiens
KKKLRDNMPIDNGQITNDNKLTAASAVTGQSAAWEGRGQDCLLLYFLYHPPHVRTNPRKRSPNQSQKTSCFLLAHLQFPTACGQNHLEPSPFSTPCVLAPTHTGDVADSLAVASSEYCFSFGWFSFISTFELLWLRTESICKKCFMLNERSRIKISYMTSVKL

SEQ ID NO: 784978 - protein, 69 aa, Homo sapiens
PPIAQHRYIDKWNRTEAFLITPHIYNRFTFDKQDKKGNGERIPYLINGVEDNITMLSPTPRECYDGIIK

SEQ ID NO: 784979 - protein, 76 aa, Homo sapiens
AEGTPINHIQIQEKKTWAQNEGFQINVQKKVDKGKRLRICACGRSQEIRINHRKKNHHDNVPFTTVFLTTAAPGGT

SEQ ID NO: 784980 - protein, 111 aa, Homo sapiens
SLPSQCPLPSPALVTACGDPGAPRPRRTAVDRGEGGGKDEGYGEAEMGWGKGWWKGKEKTGGMQAAPQPAVPAAASSGAGQAVQYSPPLHLSHHYLSPQPTTRTHPSHPHP

SEQ ID NO: 784981 - protein, 219 aa, Homo sapiens
AACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLGEVVVQICSVSSQHKRGNDGRVSLIKQRESTLGIMYRSELLSFIKKLREPLVLTIILSLLVKLHKVREDIVNDITAEHISIWPSPFPTPVCDFEA

SEQ ID NO: 784982 - protein, 160 aa, Homo sapiens
DRTQRKRARVRIGRSYSGPCAEHQECVLQKSLSLSPRLECSGAISAHCKLRLPGSCHSPASASRVAGTTGVRHHAQGEEKKVHEVKKKQGMREKNGGVSATAQSVSATWSLTLSPGWSAVSSLQPPPPGFKRFSCLRLLSSWDYRYLEIITGTFSGQTRT

SEQ ID NO: 784983 - protein, 133 aa, Homo sapiens
SCRPYVDPHKSGHEIWEEFSMSFTPAVKEVVEFAKRIPGFRDLSQHDQVNLLKAGTFEVLMVRFASLFDAKERTVTFLSGKKYSVDDLHSMGAGDLLNSMFEFSEKLNALQLSDEEMSLFTAVVLVSAGNLCI

SEQ ID NO: 784984 - protein, 383 aa, Homo sapiens
MDNASFSEPWPANASGPDPALSCSNASTLAPLPVPLAVAVPVVYAVICAVGLAGNSAVLYVLLRAPRMKTVTNLFILNLAIADELFTLVLPINIADFLLRQWPFGELMCKLIVAIDQYNTFSSLYFLTVMSADRYLVVLATAESRRVAGRTYSAARAVSLAVWGIVTLVVLPFAVFARLDDEQGRRQCVLVFPQPEAFWWRASRLYTLVLGFAIPVSTICVLYTTLLCRLHAMRLDSHAKALERAKKRVTFLVVAILAVCLLCWTPYHLSTVVALTTDLPQTPLVIAISYFITSLSYANSCLNPFLYAFLDASFRRNLRQLINLPRGSLTPPASGSATARHSWPAREERPRVRDQTGRLCSGETDSRPIPDLADRKRCSCARS

SEQ ID NO: 784985 - protein, 91 aa, Homo sapiens
MSRPFFRPSSAGFAFSLSLGSPDRCLSFSICFILSLCRLWRSSISRSFWDSILSKLVIIRSPSPRSFSLGLASFLPGSLDGATLSFPLLIF

SEQ ID NO: 784986 - protein, 124 aa, Homo sapiens
HACPLHKLLTEDTLCVFFPTQSLNCDSSLFPLSCPQSGLVAYLILKCLECGKTLPYHNYHSFCPRIGEFPKPNSSAYGFVFELPLTSRFAHSYKPFEVGNKHLLSAYPLENETKNKHLQCAWML

SEQ ID NO: 784987 - protein, 52 aa, Homo sapiens
IQHPPHQPCCSCSGVSKQGALSTQMRKVRLREGNRLASGSRTVKLDKVQSVG

SEQ ID NO: 784988 - protein, 154 aa, Homo sapiens
PRTRHEVWRQSSIRRRWKRKWYRAPALPGEVCKHSCSRAREPLEVRPQELHHSGAGAGRGQQRAGVPRSTAPVRAPRTSSCGGRPRPLSRTWRAPPHTLKSPGEQRETDSPTPSRKDTPALPAVHGKGEVANLDGVRRPELRRVAFHGAPGLIS

SEQ ID NO: 784989 - protein, 215 aa, Homo sapiens
QAEGTPPTFPFPPLLQSHPSSFHPFWDVARASLQDLPAGPGPRAPLGAEWGGGMRAYHLHPQALPPEDHPFQALARPPKACGGRAPALPGEVCKHSCSRAREPLEVRPQELHHSGAGAGRGQQRAGVPRSTAPVRAPRTSSCGGRPRPLSRTWRAPPHTLKSPGEQRETDSPTPSRKDTPALPAVHGKGEVANLDGVRRPELRRVAFHGAPGLIS

SEQ ID NO: 784990 - protein, 580 aa, Homo sapiens
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVETTSSIGIGILNCLVQHSTPVPRQCLVYV

SEQ ID NO: 784991 - protein, 116 aa, Homo sapiens
MSEGNIPPFGGSGALGTHTVERVLIGPKPFWGSWGHKNGCGQRGFANTFWRSRRFPLGPLGVWGQRLEREKRQRKGVEIHVGGDNFGPVERKWPCDYRGLEISKGEITRVSNTRKA

SEQ ID NO: 784992 - protein, 444 aa, Homo sapiens
MHMKFYSCACFSPALFHLIRSFLGGFVLAAIQMPNRAVLHTLLLGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVETTSSIGIGILNCLVQHSTPVPRQCLVYV

SEQ ID NO: 784993 - protein, 618 aa, Homo sapiens
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVEAIVLLTELIRENFRNSKLKQCLLPTLGELIYLVATQEEKKKNPRECWAVPLAAYTVLMRCLREGEL

SEQ ID NO: 784994 - protein, 732 aa, Homo sapiens
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVEAIVLLTELIRENFRNSKLKQCLLPTLGELIYLVATQEEKKKNPRECWAVPLAAYTVLMRCLREGEERVVNHMAAKIIENVCTTFSAQAQGFITGEIGPILWYLFRHSTADSLRITAVSALCRITRHSPTAFQNVIEKVGLNPVINSLASAICKVQQYMLTLFTAMLSCGIHLQRLIQEKV

SEQ ID NO: 784995 - protein, 513 aa, Homo sapiens
MVDYFHGCTHGQGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVETTSSIGIGILNCLVQHSTPVPRQCLVYV

SEQ ID NO: 784996 - protein, 582 aa, Homo sapiens [sequence omitted]

SEQ ID NO: 784997 - protein, 109 aa, Homo sapiens
MAAKIIENVCTTFSAQAQGFITGEIGPILWYLFRHSTADSLRITAVSALCRITRHSPTAFQNVIEKVGLNPVINSLASAICKVQQYMLTLFTAMLSCGIHLQRLIQEKV

SEQ ID NO: 784998 - protein, 237 aa, Homo sapiens
EEEPEEEEEEEEDLIDGFAIASFATLEALQKDASLQPPERLEHRLKHSGKRKRGGSSGATGEPGDSSDREPGRPPGDRARKWPNKRRRKEVSDDDLDPSFTVSTSKGWSQGLGLEAREGSGVSMSLNCACLPSCPTASGPHGAFNGNCEAKLSVVPKVSGLERSQEQPPGPDPLLVPFPPKEPPPPPVPRPPVSPPAPLPATPSLPPPPQPQLQLRVSPFGLRTSPYGSSLDLSTGR

SEQ ID NO: 784999 - protein, 267 aa, Homo sapiens
EEEPEEEEEEEEDLIDGFAIASFATLEALQKDASLQPPERLEHRLKHSGKRKRGGSSGATGEPGDSSDREPGRPPGDRARKWPNKRRRKEASSRHSLEAGYICDAESDLDERVSDDDLDPSFTVSTSKASGPHGAFNGNCEAKLSVVPKVSGLERSQEQPPGPDPLLVPFPPKEQRERRRSLCGEAQAKKLGNNCVFAPADVTSEKDVQTALALAKGKFGRVDVAVNCAGIGGGSKTYNLKKGSTIPWKIPGSLDVNSWALQCDPLV

SEQ ID NO: 785000 - protein, 165 aa, Homo sapiens
MRLAWVSKWVGSLACRPKVVSSTSLPRVLSPIPWFSFPLLLPPPSIAPPSSSWNQPFSVSPKSGGMSWRRNGVRGALSYPHTHTHQGENTVSDDDLDPSFTVSTSKASGPHGAFNGNCEAKLSVVPKVSGLERSQEQPPGPDPLLVPFPPKEITRSVFSTSCAPT

SEQ ID NO: 785001 - protein, 143 aa, Homo sapiens
EEEPEEEEEEEEDLIDGFAIASFATLEALQKDASLQPPERLEHRLKHSGKRKRGGSSGATGEPGDSSDREPGRPPGDRARKWPNKRRRKEASSRHSLEAGYICDAESDLDERVSGARAWVGSVTACKRDCSIKVFCVQQTAFP

SEQ ID NO: 785002 - protein, 80 aa, Homo sapiens
QTLRLSPARSVPVCRHPLRLNPARSMPVCRHSQAEPRTLRARLQTLSQAEPRTLCARLQTPSQAEPDMLRARLQTLSQTV

SEQ ID NO: 785003 - protein, 68 aa, Homo sapiens
GVLEDPVCHFSKGGDNGVQSVCAFMARNYVLSVAQYSCSKWSHHVYSKSADRGGNPWLCSTIMTTTIY

SEQ ID NO: 785004 - protein, 55 aa, Homo sapiens
KGTLYHFSLCTHENFISLGQVKNCTCRLIECALFLLTLIGSDNLSTTTTTRHIYI

SEQ ID NO: 785005 - protein, 71 aa, Homo sapiens
REGWRFCKHVLRSLEFQILSRPGKSMCIYYQPGGCLKYIPRQPVTGFCPPLLQSQSPSTLGPSDLGHPPAP

SEQ ID NO: 785006 - protein, 109 aa, Homo sapiens
MATSYRSARARDAVTPSKTTGVGLRRLGAFRLGATIRISVNTTDHSSEGVSVTPASMEDRGGPGDGNGRRYGGPPRGRREMKPPENGGGQAGPPWAGGNRGEKKQGGRH

SEQ ID NO: 785007 - protein, 113 aa, Homo sapiens
DGQCPPSLFYWNRSKAEKLKSGAAHGPTVYTEGVMSSPWTTVYTQGVRSSPGTAVYTEGVRSSPGTTVYTESVRSSPGTAVHTKSAKEQPRDRRPHRGRQGADSSPETQGRLT

SEQ ID NO: 785008 - protein, 73 aa, Homo sapiens
PGDEQGTMAKYPPFGGSQPLWPHQEPQSPGAIPGLPGVREGWGQKGFQGQEQTHTARPPKTTLKTLGQQGTLL

SEQ ID NO: 785009 - protein, 279 aa, Homo sapiens
MLLYRGAPAGPGAPGCGLARPGGGPQAFGIRLSTMSPRYLQSNSSSHTRPFSAIAELLDNAVDPDVSARTVFIDVEEVKNKSCLTFTDDGCGMTPHKLHRMLSSSGLNPVLRYLYRCWGDFTCRTFLSRQPSNYTRTQTAKNEEEDEEQEDDTKRQYRGQMKRGQNGCVTATRVIPLKGTQVNAPFFRPLPNQNVEARRSLVGGQDDVESIEQTSVSRQVYSKQDRVVCMKWVNYCQSPGYCMAVRQALDHNCWLLWIQGRSRATRRLVTPGVARRSLA

SEQ ID NO: 785010 - protein, 599 aa, Homo sapiens
MLLYRGAPAGPGAPGCGLARPGGGPQAFGIRLSTMSPRYLQSNSSSHTRPFSAIAELLDNAVDPDVSARTVFIDVEEVKNKSCLTFTDDGCGMTPHKLHRMLSSGIQLTGDVKDLFKENYKPLLNEIKEDTNKWKTIPCSWVGRINIVKMAILPKVIYRFNAIPIKLPMTFFTELEKTTLKFIWNQKRACITKSILRQKKKAGGITLPDFKLYYTATVTKTAWYWYQNRDIDQWNRTEPSEIMPHIYNYLIFDKPDKNKQWGKDSLSNKWCWENWLAICKKLKLDPFLTPYTKINSGGLKTLTLDLNIKLEENLGITIQDIGMGKHFMSKTPKAMATKAKIDKWDLIKLKSFCTAKETTIRVNRQPTEWEKIFTTYSSDKGLISRIYNELKQIKKKKTNNPIKKWAKDMNRHFSKEDIYAAKKHMKKCSSSLAIREMQIKTTMRCHLTPVRMAIIKKSGNNRCWRGCGEIGTLLHCWWDCKLVQPLWKSVWGFLRDLELEIPFDPAIPLLGIYPKDYKSCCYKDTCTRMFIAALFTIAKTWNQAKCPTMIDWIKKMWHIYTMEYYAAIKNDEFMSFVGTINHAAIKTHAHVCLLRHYSQ

SEQ ID NO: 785011 - protein, 275 aa, Homo sapiens
NLRLGTRPWVLRSGCPAVESMASPGAGRAPPELPERNCGYREVEYWDQRYQGAADSAPYDWFGDFSSFRALLEPELRPEDRILVLGCGNSALSYELFLGGFPNVTSVDYSSVVVAAMQARYAHVPQLRWETMDVRKLDFPSASFDVVLEKGTLDALLAGERDPWTVSSEGVHTVDQVLSEVSRVLVPGGRFISMTSAAPHFRTRHYAQAYYGWSLRHATYGSGFHFHLYLMHKGGKLSVAQLALGAQILSPPRPPTSPCFLQDSDHEDFLSAIQL

SEQ ID NO: 785012 - protein, 275 aa, Homo sapiens; identical to SEQ ID NO: 785011

SEQ ID NO: 785013 - protein, 275 aa, Homo sapiens; identical to SEQ ID NO: 785011

SEQ ID NO: 785014 - protein, 275 aa, Homo sapiens; identical to SEQ ID NO: 785011

SEQ ID NO: 785015 - protein, 266 aa, Homo sapiens
TALVRGWGGIGRGSPGAGRAPPELPERNCGYREVEYWDQRYQGAADSAPYDWFGDFSSFRALLEPELRPEDRILVLGCGNSALSYELFLGGFPNVTSVDYSSVVVAAMQARYAHVPQLRWETMDVRKLDFPSASFDVVLEKGTLDALLAGERDPWTVSSEGVHTVDQVLSEVSRVLVPGGRFISMTSAAPHFRTRHYAQAYYGWSLRHATYGSGFHFHLYLMHKGGKLSVAQLALGAQILSPPRPPTSPCFLQDSDHEDFLSAIQL

SEQ ID NO: 785016 - protein, 34 aa, Homo sapiens
MPWNMNRTMEFTPHGNKEEQPFAPLSQPGLVQGE

SEQ ID NO: 785017 - protein, 72 aa, Homo sapiens
LWQVVRVLIGRGSTGCHDLASAPEGSVWLPCGGHGVEQRQEPSESRGRGDLSLGCGAGHGTGRRWLGLRCLF

SEQ ID NO: 785018 - protein, 111 aa, Homo sapiens
MNGIHALSKEAPRLPYPFHHLRTQLGDTVYIPEIHKRRDLIETSTDTKSAVTLILDSPASTTARNKLLLFITLNKQEEKKREHQHKENNGEEKRKRGRAGGPRRGGGAEGG

SEQ ID NO: 785019 - protein, 119 aa, Homo sapiens
APVPALTLQQPLLALLAFLVPIHKPKASLPDCHRHSHPCCHGAQMTRWLWSGCQGSCAWIHASKDRHLEGFSRGAAWGSLHLGVVEGAPMGRTWLPMGGGLDRGAVGTTGLTRSLSPTP

SEQ ID NO: 785020 - protein, 105 aa, Homo sapiens
QTSSFCPRTFVLTALQSGMHFTWSFFVSHFKDGISLCCPIWSAVVVHRHDRSALQPRTPQLKQSSHLSSLSSWEYRHMTPYLVSSSLTTFKNLLRCDHLIAVFTT

SEQ ID NO: 785021 - protein, 105 aa, Homo sapiens
WLFCACVLSPSARSRPQNTRVQRNLGHSPGAQPRWVLGDHIFSGPFIQKPGPGVGGASCLVLFSRFLLLLATSLSLPVLQLFSCGLLFTSLEAALGAQLVGRGAP

SEQ ID NO: 785022 - protein, 52 aa, Homo sapiens
CWDWRCEPPRSTLMDIYYMQTDDYLQGVGVFGIRPGEKRFQDSIYGEFKVWR

SEQ ID NO: 785023 - protein, 124 aa, Homo sapiens
PALCTTPYVALCSSLHLSPLFSFSHHYREVILKCLGCSRSCQTFTNHHVHIRCRDKTAQSLNTLFCITHLGQSKIFQSQLKRGKQKVLQICSLLGTELVLVDKRPCAQRACSPEGRQTRNTGSK

SEQ ID NO: 785024 - protein, 181 aa, Homo sapiens
MGNETKAPRPPLGRGFYSQDGGACLGRSRDRAGLLCMTQRDRDWLGGDGVSIQKAGGGRQGRRPQGGRGMWGWEALTGLWKAKELAGLPGSLWSSWGALLSALPASEVSGCLPGSLKLVCGGSLRGNLKKTQALPLGHCTGPPPGSSSSISHSCPTCPAPSAHPRPCQGHIFTSSAAAEGA

SEQ ID NO: 785025 - protein, 136 aa, Homo sapiens
AGCEECVGGAEVSWQREQSMSSGWVHGGQVQVGARMMPTAPACLQEGALGCAAFGIVSMGAPASGPQKNVAVTGSISELRRRCPDGRGQLGLQAPLPLTQSRPQVGKTRVQVPNAADWPWDCGMLLALLKPQFPHL

SEQ ID NO: 785026 - protein, 121 aa, Homo sapiens
GVLAPVVSAGLGPQAGLSPHRCPRVQRHLPPLTVAFCFLGDSSIRRCVRVTNLLQAGQLSQGGLTRQAGKLTPWGGLAGRCPDGRGQLGLQAPLPLTQSRPQVGKTRVQVPNAADWPWDCG

SEQ ID NO: 785027 - protein, 51 aa, Homo sapiens
LPPPNCQKLVEVPGLPKGPGGRAQPHKAGSLQVTDRKKAPPEPQQALLNCI

SEQ ID NO: 785028 - protein, 268 aa, Homo sapiens
SPGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGV

SEQ ID NO: 785029 - protein, 74 aa, Homo sapiens
SPGTTGDWSSEGCSTEVRPEGTVCCCDHLTFFALLLRPTLDQSTVHILTRISQAGCGVSMIFLAFTIILYAFLR

SEQ ID NO: 785030 - protein, 123 aa, Homo sapiens [sequence omitted]

SEQ ID NO: 785031 - protein, 34 aa, Homo sapiens
MGPGLHWTDGEPEARRRNKTDSSRNCIVGYGCAG

SEQ ID NO: 785032 - protein, 71 aa, Homo sapiens
IGWQMATQRQDRHREKTRERAAAQITPVSPVAEWQVRWGLAYTGQMGNLKPEEETRLTPPETALWVMGVQG

SEQ ID NO: 785033 - protein, 73 aa, Homo sapiens
RQQRNGQGLTNRNSDANCLGDGAAVTGAGVAQTLVGFRVTVQEGSSSCGPVSLLQEQPFPADAQSDPKALPES

SEQ ID NO: 785034 - protein, 119 aa, Homo sapiens
ENQYFYMPTTHNTCSNTGYFFIVALEFETFFLVPGQRQFMQFTVKLNGAGQKKKKSSLKLAKNCRLGVYKFGHLLRTVALNSLREGGIWMQFQLETDLFANNCGRDSVMSEIFFHLSTS

SEQ ID NO: 785035 - protein, 70 aa, Homo sapiens
AVDQTTSVPGATEIVPSSELSPPGFRHLVPKSQTPRTGRALLEIRTSPLPFLSKAVTLSLGGDDDSLGQG

SEQ ID NO: 785036 - protein, 93 aa, Homo sapiens
TDPPRQPGPPQIMCVCWGVGASGAEDKQAGRADSYGCDPRGACNSCPPTSVAPMEANKSGTGNGGLGEKMKRLRIREVSSSFPKGPEPRSVEA

SEQ ID NO: 785037 - protein, 68 aa, Homo sapiens
KELTILSSLEATIQSSSSKRPNPSFSEAISHSNLPGSDLHAKLQEFEGNLRETCRNQLAKEKRSQCVQ

SEQ ID NO: 785038 - protein, 207 aa, Homo sapiens
CVQFWPTAEAMLFKTFSRKVVVVSLMRKMEEEAGVRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 785039 - protein, 107 aa, Homo sapiens
RQGLALSLRLMSNGAISAQCNLYLPGPRDPPTSASHLPGATSVYHHAQLIFVFFVVEMGFCHVAQAGPELMGSSDLPTSSSQSAGITGMSHSTQPFYTVLNAQIIYF

SEQ ID NO: 785040 - protein, 64 aa, Homo sapiens
MSWGEGRVKKITSKTIDHFCLGLTPLSAGLTLACCLHSGFAEVRSSCPAGIVVVRPFWRCRVGQ

SEQ ID NO: 785041 - protein, 304 aa, Homo sapiens
VVAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDV

SEQ ID NO: 785042 - protein, 88 aa, Homo sapiens
INTPKHLCRKFKNMAFRKYLLLDKCKSPKVPIPRGNENSQHPHVPPESVISFRPTGTQLPASHLRTKLRALKCTQRKMTLSPVQQDSS

SEQ ID NO: 785043 - protein, 92 aa, Homo sapiens
DSTGSRQAIRFNCVGVHMCISVGGAFNRVGVHVCISAGVCIRLYGCACVSVGVCTFNCVGVHVCISAGGCAFDCVDVHMCVSVGVCILNRIA

SEQ ID NO: 785044 - protein, 253 aa, Homo sapiens
PQVDRRQGPEEAAGYQSGPQERAGHGRGEEAAPLPAGTVALREIRRYQKSTELLIRKLPFQRLVREIAQDFKTDLRFQSSAVTALALQEASEAYLVGLFEDTNLCAIHAKRVTIMPKDIQLVSRIRGERAYSEIRSCSQEGLQKGCYESAEEGRREAQAQPQGELLRLRVGGAEAGPPDTGISSKAMGIMNSFVNDIFERIAGEASRLAHYNKRSTITSREIQTAVRLLLPGELAKHAVSEGTKAVTKYTSSK

SEQ ID NO: 785045 - protein, 145 aa, Homo sapiens
LGRQGQAMVFKGPGDAQCKVEAFLFLLEQQQNHLAGLLSSSSEVSGRCLLLASMAAVTVARGPPQISCQENVGIYERPPLGTASGAGQEDVGGPWPDASYNNEKPEWLGSWQTVACIFLCAIHAKRVTIMPKDIQLVSRIRGERA

SEQ ID NO: 785046 - protein, 127 aa, Homo sapiens
WVWSVGSRQGRAPTGAGTELQSSSSGAQAGWGQGAEAATTEAQPLDMGSGWERAGGPLDSGGGGAICRDREGVGLGLPRRRGLGPVASVMASQLPPPHCPCHRKACPAPGMAPSLGVLAVHPGPQDG

SEQ ID NO: 785047 - protein, 110 aa, Homo sapiens
MQWSAHLCMGHRNQCLGDRHTQPCASAHEFMPTGPRRNTASQVEGSPAVPCTQDTQATPQGQAWPRSPGQPPGGHLAGVGEPRRQEHPQQLCPSSLIPSTKCCGALSWAS

SEQ ID NO: 785048 - protein, 1590 aa, Homo sapiens
ERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLEVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 785049 - protein, 1554 aa, Homo sapiens
ERRRFAARERQLREEAERERRQLADRLRSKWEAQRSRELRQLQEEMQREREAEIRQLLRWKEAEQRQLQQLLHRERDGVVRQARELQRQLAEELVNRGHCSRPGASEVSAAQCRCRLQEVLAQLRWQTDGEQAARIRYLQAALEVERQLFLKYILAHFRGHPALSGSPDPQAVHSLEEPLPQTSSGSCHAPKPACQLGSLDSLSAEVGVRSRSLGLVSSACSSSPDGLLSTHASSLDCFAPACSRSLDSTRSLPKASKSEERPSSPDTSTPGSRRLSPPPSPLPPPPPPSAHRKLSNPRGGEGSESQPCEVLTPSPPGLGHHELIKLNWLLAKALWVLARRCYTLQEENKQLRRAGCPYQADEKVKRLKVKRAELTGLARRLADRARELQETNLRAVSAPIPGESCAGLELCQVFARQRARDLSEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELDDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLEVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLRGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKVACAPSATVLN

SEQ ID NO: 785050 - protein, 94 aa, Homo sapiens
HSFQTLLGILLLEAERSLRRATGTRFQVLGAALVGAGGPLLPIDYLHPERPCVLVAADGRRLSAEQEGDRTSYVLAWGHGQACLLWSFVCLLLF

SEQ ID NO: 785051 - protein, 314 aa, Homo sapiens
MVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 785052 - protein, 109 aa, Homo sapiens
GDLLLLAFHHDCEASPATWNYQPTLTENRTYVEILGAGFLYTRGVMNIYERRNRTCTARQFTSIEGCALTDGAMNVNSNCCRMSKENSSCCLRISAGATEIKERLLNTH

SEQ ID NO: 785053 - protein, 81 aa, Homo sapiens
ASQEAAEETPPICTPGASDRNPLSYAARSARVPRPETLTTQRCPTGAGPERLSLASEWKHVHTAARTGLSDSRNVMGPWPV

SEQ ID NO: 785054 - protein, 96 aa, Homo sapiens
GHGQRSAPPLCVRNRFNPRWSDMGVCPTGECEAGIGPIPAGHNLELTLSLGEWGRSSGNNPLHQADAWTAVGETLYERSGAWEEPPHRNDNHMRTK

SEQ ID NO: 785055 - protein, 137 aa, Homo sapiens
NPVILTREAQPAPSQALPSSPGSRQPLCHPRVPSPHSLAGPPFHSSTTFPAASLRLQGSRTGASETPGPQRAPRQGQRGQTREGAGPQPRSLFMNGGAGGARPYYYAAQRALRPSAPRPLADRTADVTEPVAGGGAG

SEQ ID NO: 785056 - protein, 106 aa, Homo sapiens
DCGQPLSRGSCLWTAPQQGDHACKQPHSRRIMHVNSPTAGGHACGQPLSRGSCLWTAPQQWVVPVNSPAAGVRACGQLRSRGIMPINSHAAGGHACGQPRSRGSCL

SEQ ID NO: 785057 - protein, 78 aa, Homo sapiens
QRHLRKGLGEAARQGSGAPSSRSPRLWAEARIPTASCAWRRREAQGDGGPRRHPAGCHSFNQDVENAVDKSFKKILKP

SEQ ID NO: 785058 - protein, 109 aa, Homo sapiens
SQLLGRLRQENHLNPGGRGCSEPRSHHCAPAWVTEQDSISKKKNVVITLSIHNTSLQTPGVHLLSVNREPTNRHDISSLSHYSIHILGFLFSFTSFWNLRAEVARDPLF

SEQ ID NO: 785059 - protein, 117 aa, Homo sapiens
SQLLGRLRQENHLNPGGRGCSEPRSHHCAPAWVTEQDSISKKKNVVITLSIHNTSLQTPGVHLLSVNREPTNRHDISSLSHYSIHILGFLFSFTSFWNLRACLEVLAGEHSYLYTLD

SEQ ID NO: 785060 - protein, 109 aa, Homo sapiens
MLSGAPGEVGSVLFSLFWSVQGSLLSWCYLQLKSTDSGAKDLAVDLIEKYVGQFLASMRAILESLFSQYSGKTIVERLCNSVFSMAARQLVIFLLDFCTLDIPHCVLLR

SEQ ID NO: 785061 - protein, 67 aa, Homo sapiens
PGLVFNTPSALKAISTAMFENIRSTQFSVILSQLTLLADKIDSCLPVVISRILGESPSSSLPFYPFP

SEQ ID NO: 785062 - protein, 100 aa, Homo sapiens
RGSSVTRLEAHGPFAGSAHHVHTSSHVVSLPSSVQSMVSNSRPGAALTAIPVSRHGQGQSCLGPPSRARTLHSFCMRTLRLAATAWASSPSKRNGWGKAP

SEQ ID NO: 785063 - protein, 151 aa, Homo sapiens
MTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVTIELIDDDESDLISNSGVEPVNPFVDYR

SEQ ID NO: 785064 - protein, 220 aa, Homo sapiens
TITLTPSAETDVSLVYRGFIYPMLPGGPGGPGAEDVAVWTRAQRLHVLARMARGPDTENMEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPSVSDRIRCTFLD

SEQ ID NO: 785065 - protein, 131 aa, Homo sapiens
LDTSRVTSAIATSLLPHSSSGLLWTTVLCQTPARPQSTMIHLGHILFLLLLPVAAAQTTPGERSSLPAFYPGTSGSCSGCGSLSLPLLAGLVAADAVASLLIVGAVFLCARPRRSPAQEDGKVYINMPGRG

SEQ ID NO: 785066 - protein, 131 aa, Homo sapiens; identical to SEQ ID NO: 785065

SEQ ID NO: 785067 - protein, 112 aa, Homo sapiens
MIHLGHILFLLLLPVAAAQTTPGERSSLPAFYPGTSGSCSGCGSLSLPLLAGLVAADAVASLLIVGAGDPGLLKHDRGGDEGLFMESKMCLKENGQKGLQSLDLIPIEGQCC

SEQ ID NO: 785068 - protein, 131 aa, Homo sapiens; identical to SEQ ID NO: 785065

SEQ ID NO: 785069 - protein, 41 aa, Homo sapiens
MFLEGSAPMFLEGSAPNSGHLRQTFLEGSAPNSGHLRQMFL

SEQ ID NO: 785070 - protein, 68 aa, Homo sapiens
HSGCPVLKLLKLRNLCGMNSTLSTIATLCDSYHENLHFKKQENLKSLVLEVSIAIYLEKQLDELLSRR

SEQ ID NO: 785071 - protein, 51 aa, Homo sapiens
MVTCHPTSAVHKCLQLRWTLSCWTGKRIKLRRPRVCKQREGVDRKPCLLQG

SEQ ID NO: 785072 - protein, 42 aa, Homo sapiens
MFVLDEADEMLSRGFKDQIYDIFQKLNSNTQVVLLSATMPSD

SEQ ID NO: 785073 - protein, 256 aa, Homo sapiens
LSSGLSLRPYQECCIERPPLRLRGFGAALTTTPRLHRPCPPTSGADFTSRNLFPPGIKDFLLLCGRILLLLALLTLIISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTCVLSRVPKWDCPEEKVFEVLQAHKVLFDWDDEKLGTT

SEQ ID NO: 785074 - protein, 41 aa, Homo sapiens
KRYPKLNHYSSSLTLSLCCNHYHLSHNYLNSLKTISTHSPT

SEQ ID NO: 785075 - protein, 68 aa, Homo sapiens
GRDAMAHWSTLFLAVSASGFWRCCSVGPKFADPGSQDAGRAYAPRRTGRRVGLLLPLLARFAPQSPSL

SEQ ID NO: 785076 - protein, 86 aa, Homo sapiens
IKNNKVLLPKCWDDRPEPLRPPSPWYFLKKGCILTVHGPPSPTPLCPQVTTDLHHGCTDQHTGTSASAPLAAGMIALALEAKYVTA

SEQ ID NO: 785077 - protein, 114 aa, Homo sapiens
DAISWLRSRGRRFALGPIPRPVLLRKRGEKARNQACQALRPLSAVPPPRPSAAGSRLAGTPCLVGGKGRERARHRRLPRPAAGWRRGAVTAANGERAGPLPRRPQAWCSRPMSI

SEQ ID NO: 785078 - protein, 88 aa, Homo sapiens
PLLGTRGKLAEHRANGRRAVCQTVGTEAPQQHRPCCPFNETVVWWPVKAITGSLYRHKPPGTEQCGLSTSLGKALQSSQEQSYCWLLL

SEQ ID NO: 785079 - protein, 194 aa, Homo sapiens
GRWRGAALRARSGGPCDSWCPAGTRGAGFAESAGPRCAGCAPPRNPAPSHPISLFWERRVEPSAPTGSVGAVLGVLPDQPTPPGLSFRSIPTPLRFFFPVVNLRRGGGTVSAQGTAEVPCGGTLRRRYCGGEAGGRRICLRTRGLMACLFLLGQVERFLKAGGGARIVRKTRKDTAFYPMRGRAGLLSAGVEGS

SEQ ID NO: 785080 - protein, 85 aa, Homo sapiens
NKPQRDASATAVLARGLTSPCWKDMDLRLPGPTTTHKLRVKPTQWNLEPKMVRNGVLMIFFVSLIKLYLKPGLFRGMRQKPSFFG

SEQ ID NO: 785081 - protein, 378 aa, Homo sapiens
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPCCPDIDIFVDGKRFKAHRAILSARSSYFAAMLSGCWAESSQEYVTLQGISHVELNVMMHFIYGGTLDIPDKTNVGQILNMADMYGLEGLKEVAIYILRRDYCNFFQKPVPRTLTSILECLIIAHSVGVESLFADCMKWIVKHFARFWSERSFANIPPEIQKSCLNMLIQSLVSIT

SEQ ID NO: 785082 - protein, 250 aa, Homo sapiens
GKRFKAHRAILSARSSYFAAMLSGCWAESSQEYVTLQGISHVELNVMMHFIYGGTLDIPDKTNVGQILNMADMYGLEGLKEVAIYILRRDYCNFFQKPVPRTLTSILECLIIAHSVGVESLFADCMKWIVKHFARFWSERSFANIPPEIQKSCLNMLIQSLLWVAGACLQLRTQGWNQPWTGYHSSAGCTHSTEHSLILGHCREASSLNVHIFGMWEETGVSRENPCRHGENMQTLHRQWPGQESFFPLS

SEQ ID NO: 785083 - protein, 49 aa, Homo sapiens
IIHHEQRSADKISERISIPKKLRSSIKLTKTIGKVMFKTIYKEIRLSKR

SEQ ID NO: 785084 - protein, 79 aa, Homo sapiens
RGTLPHDCCRELEGSQQHSLPPLGSQPAACSAKSNSIHVHGAPPKHPTERNCVFNGLKSGGERNTETCLFVIPSKTSRI

SEQ ID NO: 785085 - protein, 30 aa, Homo sapiens
MVTELQNQRGLLHAGCHLLESEIKCASDTV

SEQ ID NO: 785086 - protein, 100 aa, Homo sapiens
QRRWEWGSRGSAVGCSWAPRLGALSVLSECLAQSLPPRPNMDFREILMIASKGQGVNNVPKRYSLAVGPPKKDPKVKGVQSAAVQAFLKRKEEELRRKGM

SEQ ID NO: 785087 - protein, 99 aa, Homo sapiens
QRRWEWGSRGSAVGCSWAPRLGALSVLSECLAQSLPPRPNMDFREILMIASKGQGVNNVPVSSSWGINVGDPSLPSSECVWPMELLGSPLSAPGEERPG

SEQ ID NO: 785088 - protein, 847 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSALWHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLAQAAWPQCGSSSERLSVQAMGQDRKVPELGKPGCNFLLHPAPPEVLRRVFLGIVFCSCFSVLGMGPGPDTPSRAQVRDPNPQNPKLLLKSSGTVQGRWGGDME

SEQ ID NO: 785089 - protein, 38 aa, Homo sapiens
MAFVLLQKPPVWPKDKNGREKEVSWYYLHKIKLKVNIL

SEQ ID NO: 785090 - protein, 58 aa, Homo sapiens
PTTSPMGPHTPGHCSPALIPLEPGDRQLETASRPQSRLTLFKQLILNLLNLPRPFPPT

SEQ ID NO: 785091 - protein, 115 aa, Homo sapiens
MTKKRRNNGRAKKGRSHVQPIRCTNCARCVPKDKAIKKFVIRNIVEAAAVRDISEASVFDAYVLPKLYVKLHYCVSCAIHSKVVRNRSREARKDRTPPPRFRPAGAAPRPPPKPM

SEQ ID NO: 785092 - protein, 198 aa, Homo sapiens
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGETGSLERPRQADHLRSEVQDQPGQRGETLCLLKIHTKN

SEQ ID NO: 785093 - protein, 131 aa, Homo sapiens
FVILAGVQWRDLSSLQPLLPDFKRFPCLSLLSSWDYRCAPPCLIFVFLVEMEFHHVGQAGLELLTSSDSPALASQTAGIPGVSHHAPLYLSIYLSIYLSIYLSTYHVSITFKCQRALPNYVPVYQFRKCEL

SEQ ID NO: 785094 - protein, 117 aa, Homo sapiens
RAKTRPSQISSEEAAGQPGAWSLQEQAGAWESPVASALHGALRSAWAGDTVPSGLCGRRQETKHGLPSAPVLPVPPEARVHQRWRVLRRPGRRAHRMQPSGPGVGFLLHTARCWQAP

SEQ ID NO: 785095 - protein, 179 aa, Homo sapiens
QLVRPAFDMGPGLAHACATRRPRVADAWAEKRYDYLEFTDARGRKTRYDTKVGTDKWPKKVTFKAGPRLQFLFHSDSSHNEWGYKFTVTACGLPDVAVSWGLDLQLLVSRLMGRLASQCMALKSVRQLGSNMVVPQAKMALVLSSPLWKPVFRHQVCPELELEASWPTHPHRNSKEGEV

SEQ ID NO: 785096 - protein, 140 aa, Homo sapiens
QLVRPAFDMGPGLAHACATRRPRVADAWAEKRYDYLEFTDARGRKTRYDTKVGTDKWPKKVTFKAGPRLQFLFHSDSSHNEWGYKFTVTACGLPDVAVSWGLDLQLLVSRLMGRLASQCMALKSVRRKCTSLCFPFLQPR

SEQ ID NO: 785097 - protein, 128 aa, Homo sapiens
KAWHAPANQGVTCSSSPCPGLPRAPCRRRSGEGVGGRWSREGPAENSGLGAQRALRLGARQSLSPTGARAGGSAWPCVARWLATLTPQCACASEQPCGRSDCPPFWCTGWEVELVGQSPRVGPLPELN

SEQ ID NO: 785098 - protein, 128 aa, Homo sapiens; identical to SEQ ID NO: 785097

SEQ ID NO: 785099 - protein, 128 aa, Homo sapiens; identical to SEQ ID NO: 785097

SEQ ID NO: 785100 - protein, 181 aa, Homo sapiens
KAWHAPANQGVTCSSSPCPGLPRAPCRRRSGEGVGGRWSREGPAENSGLGAQRALRLGARQSLSPTGARAGGSAWPCVARWLASDAPVRMRVRTALRAERLSSLLVYWVGGGTSRTKPSRRTLARTERHHFLREDLPELSPPHSKCCVWEFLIFCACLYYCIYCVVLYLSACVCFYTPPSL

SEQ ID NO: 785101 - protein, 86 aa, Homo sapiens
PIPSSRPRKSGAPAAELPAPRLPGPAGMRPVPAPRREQPLHSSCRELVPADSRARAAPGTRVGSGDVANLRLAAKPASRLKKDPPR

SEQ ID NO: 785102 - protein, 104 aa, Homo sapiens
MLFKLKKSMKVKASVMTLGFTCFPIVVLQTTPYFLFFSQSLSTQTLHVVSLDFLTTWWPQCIWISHMKAQDSSRRPRRKLTVMSRARPGRVSFSTELSASRVRS

SEQ ID NO: 785103 - protein, 72 aa, Homo sapiens
APAPTGTQRLRAPWWSLSKRSRLTARHPWSLQLWLCQPQTSSNRAHEKKHCFSFAPTAILGPRVHKENIFLK

SEQ ID NO: 785104 - protein, 104 aa, Homo sapiens
MDAPVRVVHVYYNPVGDALVRVVHAYYNLVGDALVRAVHVYYNLVGDALVRAVHVYYNLVGDALVRAVHVYYNLVGDALVRAGGACLLQPGGGTGRCMTITAWW

SEQ ID NO: 785105 - protein, 35 aa, Homo sapiens
LNFRQVIRATFRNTERGALLTTHYMAEAEAVCDRV

SEQ ID NO: 785106 - protein, 138 aa, Homo sapiens [sequence omitted]

SEQ ID NO: 785107 - protein, 364 aa, Homo sapiens
MAASGESGTSGGGGSTEEAFMTFYSEEIKMAYSIPEIHSNQHSNSDSDTKNVFLGLPGACSPWHCLQVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEINRKEREAKEMHERNDKGKEARLKLKKKPNGHTREWQKNFEASRDGRVDSWRKLPSQYEGERTERHIGLSGDHRRYNWGTWSETDQGTQGRNLSRENHIRGWKEAIFPHSSPHMRRHMRVSHTACNRHNAQQKTCGTRSGGGKHTSSTQ

SEQ ID NO: 785108 - protein, 301 aa, Homo sapiens
GGGWAGEMAASGESGTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEINRKEREAKEMHERNDKGKEARLKLKKKPNGHTREWQKNFEASRDGRVDSWRKLPSQYEGERTERHIGLSGDHRRYNWGTWSETDQGTQGRNLSRENHIRGWKEAIFPHSSPHMRRHMRVSHTACNRHNAQQKTCGTRSGGGKHTSSTQ

SEQ ID NO: 785109 - protein, 330 aa, Homo sapiens
GGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEINRKEREAKEMHERNDKGKEARLKLKKKPNGHTREWQKNFEASRDGRVDSWRKLPSQYEGERTERHIGLSGDHRRYNWGTWSETDQGTQGRNLSRENHIRGWKEAIFPHSSPHMRRHMRVSHTACNRHNAQQKTCGTRSGGGKHTSSTQ

SEQ ID NO: 785110 - protein, 39 aa, Homo sapiens
MLQPPGDQSLPRKAAFSPDHRAEDSLEALSGEGLLGGKR

SEQ ID NO: 785111 - protein, 103 aa, Homo sapiens
GSRGRAPLASRGEARRTQLLCRVEAGKRLLLGPAGRARGGWSLLMMPESPEYAGSANTGRRAGPWAGGWGQRAGGRLHLPTTRSLGGRGLVKVMFGWEKGGGS

SEQ ID NO: 785112 - protein, 170 aa, Homo sapiens
CAVHRMCRGVVKTAHIWCVCTVRKLSGARALRSAGLRAWWVQGAPVARSWWGATVSGWVWGLVGRTALVPPRAERLYPRRVSGAQAPTPQPPGRLIAPCLSPAPPAPGLVPEPTAKWKKRKKTTNVFRAPGTLLPTPGLPQFPSAAAAAAAAMGDSLCSFHANDTRWVAA

SEQ ID NO: 785113 - protein, 69 aa, Homo sapiens
MQCQPICSANLFCKMGMKMTWQQQIPATPLEFFRAKLATAWYLYEECKGAHILTNTYCVPVGILGDNNN

SEQ ID NO: 785114 - protein, 77 aa, Homo sapiens
QPFTDSTPFPPCWPPTDMQVTQELQSGRGLMVTCVTYHTFKDSRNRKAGMKPQAQEASEGKNARAWLCGRVGREDET

SEQ ID NO: 785115 - protein, 282 aa, Homo sapiens
ITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTS

SEQ ID NO: 785116 - protein, 79 aa, Homo sapiens
PQPPLSHAGGLRQEPQHQHRRVTWARPRDPGLEGPETMGGFLWHTHLAPGPKWGLAEPSWNPCPQGRPRLGEPPGSWQG

SEQ ID NO: 785117 - protein, 56 aa, Homo sapiens
GHLLTVESSGGGRGLRKVAPRGVERRCLTEGHLRSRCILRTELRLDINDVGSAALE

SEQ ID NO: 785118 - protein, 40 aa, Homo sapiens
KANHALSRDEDKIGHDKKESSLEKNRPDSVISSKMFLSIH

SEQ ID NO: 785119 - protein, 135 aa, Homo sapiens
KVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVE

SEQ ID NO: 785120 - protein, 74 aa, Homo sapiens
MCAGNRQHQGGWGHPKTAAVRLPVEKAGHQVLFSKAVTDRSPVGSSFHKVWGQAGWKQDQEGGYHHSSSMRQQG

SEQ ID NO: 785121 - protein, 289 aa, Homo sapiens
GVSPLPAKNSSSNWPQDKDKIKVVAISIVKAPEKFTMLGLGVVAHTCNPRPLGGRGGRPGVQGCCELIAPLHSSLSNRARACLFSKKKKKKKKKKPGVFWGGRRQKGASLERAPWGHISVVPETPGLLWWTQGWEDIARGPPYERERQYNNSPIKRHGVNPWHKITFGKKSYRQHKRAKRTQQRTQINHHRTTGATSAQACTVNQRTDRGEPEEKNTLDRNRRGPTQNNKTNTDPETKEDRQRPSTRQDYKNPETPEQSAQAQEDGGSENAKVEEARTPGKAKTTRKET

SEQ ID NO: 785122 - protein, 57 aa, Homo sapiens
GPLQTAGAQDELPFCETRETSAALELWVNGVISKNVESGACATPGPPTWDRNSKLTN

SEQ ID NO: 785123 - protein, 119 aa, Homo sapiens
SSKNTKVSWAWWQVPAILATREAEAENCLNPGGGGCSGLRSHHCTSTWETNRDSVSKKKCTNQKGKIPSTQQKNVDVDNWKQKRRDPSWWLTSVIPVFSEAEVGELLEARSSRPAQATK

SEQ ID NO: 785124 - protein, 133 aa, Homo sapiens
GDQGLGLRDGSQPGQLETQPIPRLAQDATEMGPYTSLSDSLEQVDHRNEPCPGALKPPTNAAPSLLTQKGWAKVGPDRTRCAMVLTAARRVEIPGEPRPRVPTPHAGDLYAPQLQGFCCLNTRSRYGGRSWHP

SEQ ID NO: 785125 - protein, 598 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 785126 - protein, 478 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 785127 - protein, 205 aa, Homo sapiens
ALHRVDTGLLRSFLQRCPGLRVMEHSRVLTLALHADPTRTRLSDWVHCLSPSSSSSFSLSPNQVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSPRSRNMPCSGRPARLPSCSGVGTGVQGTWRRKGRALFCKKIR

SEQ ID NO: 785128 - protein, 585 aa, Homo sapiens
ISRNYYKVNIQVTTTTVRKLYITLWFALSLPSSPVCLLKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGNEMTNLAFELDPLELEEEEAELGEQSGSAKTSVSSVTTPPPHGKRIPFFKKTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 785129 - protein, 191 aa, Homo sapiens
ALHRVDTGLLRSFLQRCPGLRVMEHSRVLTLALHADPTRTRLSDWVHCLSPSSSSSFSLSPNQVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 785130 - protein, 523 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGNEMTNLAFELDPLELEEEEAELGEQSGSAKTSVSSVTTPPPHGKRIPFFKKTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 785131 - protein, 370 aa, Homo sapiens
MRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 785132 - protein, 311 aa, Homo sapiens
ALHRVDTGLLRSFLQRCPGLRVMEHSRVLTLALHADPTRTRLSDWVHCLSPSSSSSFSLSPNQVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 785133 - protein, 86 aa, Homo sapiens
ECGVSSRLLKMNRLFGKAKPKAAAASLMMHATVDSRAESIDKKISRLDAELVKYKDQIKKMREGPATGIWSSRKPGGVLTRNKRHV

SEQ ID NO: 785134 - protein, 44 aa, Homo sapiens
ELTRDAELEEAMVVISLEGPKCMLGDCLAGIYMTFQAPGSLRFS

SEQ ID NO: 785135 - protein, 70 aa, Homo sapiens
FGGGKTTGFGMIYDSLDYAKKNEPKHRLARHGLYEKKKTSRKQRKECKNPIKKVRGTAKANVGAGKKSKK

SEQ ID NO: 785136 - protein, 66 aa, Homo sapiens
VQALKPGQALKPGQALKPGQALKPGQALKPGQALKPGQALKPGQALKPGQALKPGLKLSNKLSLLL

SEQ ID NO: 785137 - protein, 125 aa, Homo sapiens
MDTFGGHHAANHREESSIRMTVVGWEKLQNEEQGSGLPSPSLHVDTGSLLLHARDLRRGRMSGFFPFISPHFCQEMKSHAALSVSVLVESTFLIGTKTASSISDCPSVSLTASASLSASFCLLSL

SEQ ID NO: 785138 - protein, 97 aa, Homo sapiens
KTKQADVFGGPRVPRLETGPLAVPTCILGQRCGGRTLGLSPAELGPGRGPNHASRRRPSIPPRNREIPARQCSHGVESRVRTWHSQSLDNRLFSPVK

SEQ ID NO: 785139 - protein, 186 aa, Homo sapiens
MMIIPHLLRDKDQRATTATSPRTRQCWGTENEGVQLWPSQSSGGDETHLPLSLWARLMPGASVDRGHAPGLPKLEKAARLRSEGQNSTVSPTESRWEQGRWLPRLCGRIRFLAVEVACTPQLVLPVSNDWSFLLLSLHLPPSPITCSALTRIRVESCSVIQASSGVILARCNVCLLGSDDSPASAS

SEQ ID NO: 785140 - protein, 328 aa, Homo sapiens
MLLPPGSLSRPRTFSSQPLQTKLMTHNGLFRPIPYVTAVSADEATASQQPPQAQLHRYNGLFRPSSCLPAFSPGPELSQVDLTRPSSCFFAASPGPAPASWWPLQAQPLPPVGLYSPNICLTADSSGPASASLWTPQAKLPTFQQLLHTQLLPPSGFFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLASPGPAPASCQRLEAQPLPHGGFSRPTSSSWLGLQAQLLPHNSLFWPSSCPAHGGQCRPKTSSSQTLQAPPPDAFI

SEQ ID NO: 785141 - protein, 192 aa, Homo sapiens
PCCPAYASGAWPSDVTAKASVSSRIRRGTCLLSLPRATMSKRNQVSYVRPAEPAFLARFKERVGYREGPTVETKRIQPQPPDEDGDHSDKEDEQPQVVVLKKGDLSVEEVMKIKAEIKAAKADEEPTPADGRIIYRKPVKHPSDEKYSGLTASSKKKKPNEDEVNQDSVKKNSQKQIKNSSLLSFDNEDENE

SEQ ID NO: 785142 - protein, 151 aa, Homo sapiens
RHVARPTHRGRGPVTSQLSASVSSRIRRGTCLLSLPRATMSKRNQVSYVRPAEPAFLARFKERVGYREGPTVETKVSLRQSCFFGSAASPPLSTFASTWRVGAVGSLFSPALEPNSGGTRTPRLVLFKRPQPPTPRKLCSFQSAAVFLKMN

SEQ ID NO: 785143 - protein, 192 aa, Homo sapiens; identical to SEQ ID NO: 785141

SEQ ID NO: 785144 - protein, 134 aa, Homo sapiens
FAAASTRQKGPTVETKRIQPQPPDEDGDHSDKEDEQPQVVVLKKGDLSVEEVMKIKAEIKAAKADEEPTPADGRIIYRKPVKHPSDEKYSGLTASSKKKKPNEDEVNQDSVKKNSQKQIKNSSLLSFDNEDENE

SEQ ID NO: 785145 - protein, 163 aa, Homo sapiens
RHVARPTHRGRGPVTSQLSASVSSRIRRGTCLLSLPRATMSKRNQRIQPQPPDEDGDHSDKEDEQPQVVVLKKGDLSVEEVMKIKAEIKAAKADEEPTPADGRIIYRKPVKHPSDEKYSGLTASSKKKKPNEDEVNQDSVKKNSQKQIKNSSLLSFDNEDENE

SEQ ID NO: 785146 - protein, 535 aa, Homo sapiens
MLSHADLLDARLGMKDAAELLGHREAVKCRLGVGGSDPGGHPGDLAPNSDPVEGATLLPGEDITTVGSTPASLAVSAKDPDKQPGPQGGPNPSQAGQQQGQQKQKRHRTRFTPAQLNELERSFAKTHYPDIFMREELALRIGLTESRVQVWFQNRRAKWKKRKKTTNVFRAPGTLLPTPGLPQFPSAAAAAAAAMGDSLCSFHANDTRWAAAAMPGVSQLPLPPALGRQQAMAQSLSQCSLAAGPPPNSMGLSNSLAGSNGAGLQSHLYQPAFPGMVPASLPGPSNVSGSPQLCSSPDSSDVWRGTSIASLRRKALEHTVIYELHLMQPRPGPLRPQHRPGGRPEALPARTRTPAPCPVPPRPSPRLVSSSPLSSTRSGSPQAPAREASPPPDFDRPRSPVSRPPLFPSHPAAPSARSPAPQPTLPATLASLLALAVLAPSSWPSDGRRSHPHLRRDAYDPPRPPPPLRSPLSPHFATLLPRPAKSILPAILRTRESTQDLKSDTNGLVCGQKHTHSHSRSRSDATHARAQTRCT

SEQ ID NO: 785147 - protein, 82 aa, Homo sapiens
TCTQMSTGTHTHAHTQMSTGTHTHTHMQVHTRTPTCTQCRYTPTPTCTHMQVHTHTPTCTHTDEHGYTHAHPHAHTCRYTHT

SEQ ID NO: 785148 - protein, 88 aa, Homo sapiens
LFWLWVSVSLSLSSLCLPLSLGLCLPLTWVLSLGPHLSLPVSVHLPYLSLSILAPLFHLLSLSLLSLPVSAILALSLLSSYNLASPHL

SEQ ID NO: 785149 - protein, 127 aa, Homo sapiens
MAPSIQGPLPFWSWVRRSQKESSGNSLPSPPDLVLMLFLFFFFLRRSLALSPRLECSGTISVHCNLRLLGSSDSRASASRVPGTTGVYHHTQLTFVFLVEMRFHHVGQAGLKLLASSDLPASASQSA

SEQ ID NO: 785150 - protein, 81 aa, Homo sapiens
SRPLFPKLGTSENPFSSCPAESHGARPGFLRTGFQKYLEPCMTEAELSTLSGSGRGCQTDEEMCRSLGCLSVPCEKFQARQ

SEQ ID NO: 785151 - protein, 109 aa, Homo sapiens
TVPWLTSLPRGTEALLCWCLHVHVLGIESSPARLLLRGGWAGGSSRQGGRQDHSPQVWAFSLPPASFPALCPVPCASPARSPSPSPAARGASPPRAGSPAQPHNYACKI

SEQ ID NO: 785152 - protein, 36 aa, Homo sapiens
PYGCLGCESPSALKGLQMAFSTLAAFGATCSFGKEK

SEQ ID NO: 785153 - protein, 109 aa, Homo sapiens
SLGICLSVSAFSVSRTVSCLSWSLGPERSLALSLMTAGFWLSVLALRVSRPRTAHQLVFPRRGKSTFGVRVSQARRAPPAALRRALSAGGAPLTLLSPLSTSAPPRQAS

SEQ ID NO: 785154 - protein, 711 aa, Homo sapiens
RARFPGSAAASIPAPAEGALTMAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 785155 - protein, 711 aa, Homo sapiens; identical to SEQ ID NO: 785154

SEQ ID NO: 785156 - protein, 490 aa, Homo sapiens
MQDGRSSCVHEGAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 785157 - protein, 324 aa, Homo sapiens
MGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQVRTWGTGTGALGVGPPMVLQTGL

SEQ ID NO: 785158 - protein, 505 aa, Homo sapiens
MGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 785159 - protein, 234 aa, Homo sapiens [sequence omitted]

SEQ ID NO: 785160 - protein, 58 aa, Homo sapiens
EKMLRTQRRVEAEAQVGGQELGWAPEGAGMHSLWTSARHRLRGLLIPRPCCLPPATPG

SEQ ID NO: 785161 - protein, 27 aa, Homo sapiens
MGKACTRCYENKEKGLSHQTGQSRMTF

SEQ ID NO: 785162 - protein, 138 aa, Homo sapiens
RPRPPQLRAQLSEQLSLRLGGAWPLPPGGAFVSSKLSLFSGFLIPGTQTWAVNPPGLRGRCLHRLADPALKCRWWNSPGGTARAEPTGCRGGWGHGPPPSAFSGTAPAEPTGHGDALRAPSSSPSACSGTARAEPTCG

SEQ ID NO: 785163 - protein, 166 aa, Homo sapiens
RTQKARHREMTWEAGKESIPRESLSVTRSGVKWRSLSSLQPLPPRFKQFFCLSLPSSWDYRCWTAESRGSRHQQVWCPPRTLPVVCQHGDVLPGVLTVVPLPLGVPGIALSVYFCVSDLSRPPPNPQGLTDGVHARTGVHRRDLVINAGSVYCDWRSSLRPRLGKR

SEQ ID NO: 785164 - protein, 179 aa, Homo sapiens
PAVPLAVKDAVGRVEPRTRDARPNLVPMGGVGVAEAARPLLSWPTISLTIFTAVNSSQGGGLVQRQLRFHNSHRVLCRRCPCPPTPAWWECDARLLPPPWPPVPPASTSPEILPTPHLHRSPHAPGAPKPPPNPTHPGAGTGVSELSQGPWEVAGTGASCSLFHFPFRIWPGWRTGQDG

SEQ ID NO: 785165 - protein, 179 aa, Homo sapiens; identical to SEQ ID NO: 785164

SEQ ID NO: 785166 - protein, 131 aa, Homo sapiens
TVGQKQTQTHPAQPRSSAISSEDSDVSVSQQLRPWPQVTHYAACTSPQSPPTCGFLQPQALTRVRPPQKERPQPTGSAIGPTPTNSPCDTKGPSLLRLSAALPRASFPSPQVCRRLPPEPWPGSGVLRLAP

SEQ ID NO: 785167 - protein, 88 aa, Homo sapiens
KIMLAIITKMTLTQVSTWFANARRRLKKENKMTWAPKNKGGEERKAEGGEEDSLGCLTADTKGTENVHHPTLRVLQVIKQFGLSKAAL

SEQ ID NO: 785168 - protein, 53 aa, Homo sapiens
MLLPFPHKHAAALRERTRDLLSSSRLAASAAEMNISNRLINCFIVTQENHSVK

SEQ ID NO: 785169 - protein, 51 aa, Homo sapiens
TVEGEAGTSYLAAGEREREKEELSNANKTLDLMRTHYHKNSVGETTSMIHS

SEQ ID NO: 785170 - protein, 132 aa, Homo sapiens
GGRSWGAGGPAPARRGLWASAPRRPSPPARPVGAEFGLPGPGGAACGGAPQRQPGAHAPAPCTPCTPCNPYARRAPGPHPASVRGRGCGCGARGAVRRWGRQGVPLSGPRGSEGGERDGRRLSPAGGVLRRP

SEQ ID NO: 785171 - protein, 110 aa, Homo sapiens
MRLTRSCSPGTFLESSSCLGLCPLHPTPISLMVPGLSAQSEGMCLNADTNGSLKVYNRQQKPCVTWVRRGCMSSFYFRVFRGLYHNFGALAKPTSDFMLHGYVFKQLSPR

SEQ ID NO: 785172 - protein, 372 aa, Homo sapiens
KHQMADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTRAQRGLHIRVSSQKHNGASGVNKTQGGRRRKPRGPHSGTRFGTGPKEGKKRGATKREGKQGREHTWAQKPESRKSGRPLDHNDA

SEQ ID NO: 785173 - protein, 144 aa, Homo sapiens
SKQQMPASVTPPLTESLWDSLKCMSDTVRKRQENEKKTWMFSIFELMQAGDNSCQSCKAEHPEKWNRRIQAPVEGINESRGVWMGLFLSSVWLKLQTPGVTQWVASTLPSTSAGIAKSNGKKNWFVILTPVLKEVGEAEREDWF

SEQ ID NO: 785174 - protein, 46 aa, Homo sapiens
MTSTRVTSTRVKSAHTRDIHTRDTHMRDTSTHVTSTHMTSAHTCDI

SEQ ID NO: 785175 - protein, 50 aa, Homo sapiens
SGRFSRCCSCSDGKWDALGQVWQWRRTQQLDYRHLAPGHVDEEKGRPGMT

SEQ ID NO: 785176 - protein, 107 aa, Homo sapiens
RRSLTLLPRLECSGVILANCNLCLLGSSDSPASASRVAGITGTRHQAQLIFVFSVETGFHHVGQAGLELLTSRDPHALASQSAGITGVSHRAQPDYVLATVIHTYST

SEQ ID NO: 785177 - protein, 103 aa, Homo sapiens
PQPSPRGPLNPHPGFSPQFSPPSLPSAFTPGSPEPTPRGSLPSALTPGSSQPSPQGCLLSLTPGFPPLVPCPLPLIRFQEELRSEPGFLALGSPSLFVCAVLC

SEQ ID NO: 785178 - protein, 68 aa, Homo sapiens
QEEDGNTSGRSGPSLSLKPLLPPLAGSAPSNPADPVGHGKLDSTHEPGLEGGGGMGAGYREGARVRAV

SEQ ID NO: 785179 - protein, 115 aa, Homo sapiens
ALRRSLHTWEDPGRGTISAEYSLCSLEEQCLPQHSDLCDTGACGPAPCPVPRGGHLGTQAVVWCGGSKPSRSLCSHRSHVWRHQEVESGAGQPRLLPVSHRGALRSSQLAWFALL

SEQ ID NO: 785180 - protein, 169 aa, Homo sapiens
IHGEMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVCGEPYTHYCKIPPTSLRS

SEQ ID NO: 785181 - protein, 256 aa, Homo sapiens
IHGEMRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHMSASCRDCTETARCPGSPALPPKAAPASPLREGLSPMSLRRRSWLPYLKEEIAMAVLLGRRARKFGPVGPSRIQWCCAGEGMCHHQGPFVEFPPGTLVCKRVCGPREPFCGTCTKRSGPDYTTNGSMAE

SEQ ID NO: 785182 - protein, 103 aa, Homo sapiens
SFVELAVAAKLPGESHWFALGTTKMVVLGAVCVNHLVFCVFLACNPAWPCLRGGRLLHAGPFSLHQLLLVDSLYSVQKRRNISVPSFGGLSWWLIIFPPNRTK

SEQ ID NO: 785183 - protein, 51 aa, Homo sapiens
MDFKSSRAQGLYSGAFTLLQKSTKVQDSLTMGKQMSRPRLLLQHTCTQCLP

SEQ ID NO: 785184 - protein, 110 aa, Homo sapiens
AITIRTFKIMRAPVCSSFLITTKALGTPCWMKEAFFPPLYQCGITQVSTWNRRNYLKNGVLKSTLKSAMAHDPLSPVLSDPRLDAMDQWLLSVLATVEQCTDQFGMDTVW

SEQ ID NO: 785185 - protein, 113 aa, Homo sapiens
QRRTLIAIFKENKRPSKEMQVTISQQLGLELNTVSNFFMNARRRCMNRWAEEPSTAPGGPRRRHGHFLQGLRRPGPAPSLPPRPGRCAPTSPPHILPARRPAPRGHLEGVLSG

SEQ ID NO: 785186 - protein, 168 aa, Homo sapiens
CAPYCPPHLRGTRETEYWGHAVVTTACWGHVTAQSLGPPSCNVSMRMGTLAVEEHPPSRSLAGQVLDGGCSGTPNLDQIWGGDPSTTLQGGEGPGVGLHRPYCSHRCGGSGLHWPKTGLKTAGGRTRLFTGWKDEDVLGWGPQRLQLVGQLPAVTTGQQHLELVFPLK

SEQ ID NO: 785187 - protein, 59 aa, Homo sapiens
DSQEARAARLGSGSDSDSDSDCQPRGPRTPACGRPCSRRRPLRRGARVGAGLRGPLGRP

SEQ ID NO: 785188 - protein, 66 aa, Homo sapiens
LFRQPTLSRVIGRYSEAAMEGEPDSCFIPSVEHCKAAAAAALRTNFRLLSARQEDVILPLSFSEGQ

SEQ ID NO: 785189 - protein, 178 aa, Homo sapiens
ANTAAIQAILYNRYRRYGAAGGGCFSAASCDSERLLSAGAWLPGGPRAASSSPTERPRTAWGLVFVCILSQQPRKGRRLAPGLRQCFPAGLLVVRREARRLPGSEADSLRTISVKDSAPGSPGLRRYPRKLCPSALAHRECPALKIWSFLFPESGLLFRFYLCFPFLPSYCQFVFRHY

SEQ ID NO: 785190 - protein, 261 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETGPYWTRSRRKTGTLHTPGNQGVQ

SEQ ID NO: 785191 - protein, 259 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETGPYWTRSRRKTGTLQPWNSDS

SEQ ID NO: 785192 - protein, 259 aa, Homo sapiens; identical to SEQ ID NO: 785191

SEQ ID NO: 785193 - protein, 259 aa, Homo sapiens; identical to SEQ ID NO: 785191

SEQ ID NO: 785194 - protein, 259 aa, Homo sapiens; identical to SEQ ID NO: 785191

SEQ ID NO: 785195 - protein, 292 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDGTLLGEEFQTEAREHEALLLADSRGWTPWTVRKGVHGSEETRGMTHSSNNYRTGPMKGATKLGQLRNGTLARSEEQMKRKRRTGRQKGPEARRWHQKEEPNRQRTHGSGGTRSQEPGPEDTDDTKQ

SEQ ID NO: 785196 - protein, 110 aa, Homo sapiens
QPPGKSCFLEHKEPLRPPAGLEEGVTSLLPAMSWAPFSALHTSSACRVPGHSGCLLCPHMVLASLPPRLPPASVSPPWCTAPHPAPLPPSPPRSCPRDPQSFSSRTSSAR

SEQ ID NO: 785197 - protein, 277 aa, Homo sapiens
NKRLAHSARPAGICCVSRSGLSALAAAGTASMFQLPILNFSPQQVAGVCETLEESGDVERLGRFLWSLPVAPAACEALNKNESVLRARAIVAFHGGNYRELYHILENHKFTKESHAKLQALWLEAHYQEAEKLRGRPLGPVDKYRVRKKFPLPRTIWDGEQKTHCFKERTRNLLREWYLQDPYPNPSKKRELAQATGLTPTQVGNWFKNRRQRDRAAAAKNRLQQQVLSQGSGRALRAEGDGTPEVLGVATSPAASLSSKAATSAISITSSDSECDI

SEQ ID NO: 785198 - protein, 113 aa, Homo sapiens
GGGEGGEGGGEGARGGRSRRIPRTLPAPPAVGLGAQRERRERAFPPRGSPCRWSNLRRCSSVWEEGSLQDRGAVVHTPSVVTSDRWAPGTPGIPPNLLRFGKKPAAIPPPPKS

SEQ ID NO: 785199 - protein, 31 aa, Homo sapiens
MTHTGQLHHHVMIKVNMPECSLGASNCLNNF

SEQ ID NO: 785200 - protein, 112 aa, Homo sapiens
MCGDLTPVLAPAAEAEAQAGGDLLFPGLSRESLHSPQEPALRYHPQGQETSLGESPETGSLAMPWRTHPLYSRTSGFGLGVSAQGSLPSNQPPASEPGPPPPSRCGSLSLSF

SEQ ID NO: 785201 - protein, 114 aa, Homo sapiens
LSDYLVKPPCTTMGETEAQRGKDQTSHNQARGRSGPMPGFLDSQSSALSATHPGALNKEASRVHSAGGPRIVLCPWPNTSPSSVSQSSLLLLRPDIPKRGEGVHELTLRSPPTL

SEQ ID NO: 785202 - protein, 104 aa, Homo sapiens
LSSEQPKAADLAFLPPVSRPTQVKAAKQRQRSPGAWFRPGQQVGGPDWGPGTEEGRPARTGVQGPGFRVPGLEEVAGSPPFQRLEIGWTRPEDPLGLDPDFRSA

SEQ ID NO: 785203 - protein, 151 aa, Homo sapiens
MCVYVHMCICTVEDAINRFVKVKGQAPQRNSQCAPSTSSLSVREFWIILLPGCDFGSGDHDLCLLPHIICLKVTDTAATARFPQASHLSGGEVACYSSQFLEFARQCHWNNGSFMSDFQRVGQHTCENPAVNKPLLSLGAYVPGGKVYICK

SEQ ID NO: 785204 - protein, 99 aa, Homo sapiens
SVTCRQISEMHSLSPSLQTHSRFQKVVPRIASSKGGKNTFIFPELLKVSSALELEARRGSQCRHRHVQTFATIRYLRALVLPPRRVFQELGVCDGGVVG

SEQ ID NO: 785205 - protein, 246 aa, Homo sapiens
PCAPLSPTALPPSTRGSPFASWRGLLPFVRPWSGLPQTPQLPVRRASLESPGPGVSVPSRARSGAGWHVARPSSGMRLPGDGALVQWSDGTSTSWKHRAASCHASSMESIPLFNYTGLIKLAFLILQDHGASSTDLTETADGLHKSLSTEDRIAYELPSSEHLSVADATWLALNVVSGGGSFSSSQPIGMTKIAKSVIAPLADQNISVFMLSTYQTDFILVLKRDLPFVTHTLSSEFTILWSVARL

SEQ ID NO: 785206 - protein, 99 aa, Homo sapiens
RAGCRASCKGECAAAFSFSAASGVVWSGGVSSGQADGAHVPRAEPSGLGWESGLRSQGRAQPPGPGLPRAADRGDMGQAWSRTRSQALDLCGQMRGRGC

SEQ ID NO: 785207 - protein, 117 aa, Homo sapiens [sequence omitted]

SEQ ID NO: 785208 - protein, 135 aa, Homo sapiens
TVGPHSVKLVYEHQGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSGKAIL

SEQ ID NO: 785209 - protein, 178 aa, Homo sapiens
EAFGLLLLTDSFNSTQNLPNEHLHMSVLRRFAEEKVELLEKAIAQCFACMEQPLQEGVRTARTSYRCILRACLVRSKGNQGFHQTLKAVCLKNGIYASRTLARIDLNEALTQPVYDQIDPVFGSIFRTGKPTGSALMPHIDAFKQSLQENRLNPGGIGCSEPRSRQPGRRSETMSQKK

SEQ ID NO: 785210 - protein, 117 aa, Homo sapiens
GQRRGQCPCLAQHSLPCAEEAPFVLRAPVASRTSCSNHRAKEGAVQLGFYPLPPHPSSLPPGKPQLMGWAQPRAFMGTWSPAMSHTQAVPRNVVLPYMPISYARYDAKTRGPGFSSL

SEQ ID NO: 785211 - protein, 104 aa, Homo sapiens
AFLLLSILPESSFPPFADSYVQEIIASQCYFPLELPEKVFTVPVPGFHAQNFFFFLFLSFFLFFFFGDGVSLCLPGVECSGVILAHCKLHLPGSMPFSVPQPPE

SEQ ID NO: 785212 - protein, 106 aa, Homo sapiens
MRAYLALTSTTPVKLDAITKVPIFLRKTRNRLSLKEGKNEKCPSSYNGMASIYILGSISLSCPPTLCSFCQASQSKGSQADTQGAGCGEGGSAVEKMCLVASQWRT

SEQ ID NO: 785213 - protein, 44 aa, Homo sapiens
MWSSEVVRRAQKCVFLIIAWMLITASKPPVSRFLHRMEVAGRGG

SEQ ID NO: 785214 - protein, 55 aa, Homo sapiens
GGRIIHLYIKKVGKTPEPACGMCLARLRGVRAMRPEVLVRFPKTETHVSRACGGS

SEQ ID NO: 785215 - protein, 265 aa, Homo sapiens
PGFYQRRYRKATEGYSSGKVSPDHLDPERAMLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSSNPIPKRDLLYHLHGGDSHSVLYTLHHLTNLPALREEDVLKLLQKVPAKDPQQEPDAVDAPVPEHLSQCQNLTLYQGFCAMKYAIYALCVNSHQHSQCQDCKDSLSEDLASATEPAND

SEQ ID NO: 785216 - protein, 235 aa, Homo sapiens
MLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSSNPIPKRDLLYHLHGGDSHSVLYTLHHLTNLPALREEDVLKLLQKVPAKDPQQEPDAVDAPVPEHLSQCQNLTLYQGFCAMKYAIYALCVNSHQHSQCQDCKDSLSEDLASATEPAND

SEQ ID NO: 785217 - protein, 80 aa, Homo sapiens
NSNIEFLLEQEKMLKANCVREEEKAAELQLKSKLFSFGEFNSDAQEILIDSLSKKITQVYKVCIGDAEDDGLNPIQKLVS

SEQ ID NO: 785218 - protein, 182 aa, Homo sapiens
NSNIEFLLEQEKMLKANCVREEEKAAELQLKSKLFSFGEFNSDAQEILIDSLSKKITQVYKVCIGDAEDDGLNPIQKLVKVESRLVELCDLIESIPKENVEAIERMKQKEWRQKFRDEKMKEKQRHQQERLKAALEKAVAQPKKKLGRRLVFHSKPPSGNKQQLPLVNETKTKSQEEEYFFT

SEQ ID NO: 785219 - protein, 207 aa, Homo sapiens
GSAVASPQRIQGSEPASGPIECFHIFEQREDVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKP

SEQ ID NO: 785220 - protein, 95 aa, Homo sapiens
TSRARPPHPPRDTCPWILYPWPARGRLLGKPHQPPRVFSLGYLRCEERREFREGVQGGRPWEGARLEETERGAGAKARAFAPPGRSGSTNWQSWK

SEQ ID NO: 785221 - protein, 147 aa, Homo sapiens
APRCSNFLARSWTSIYSPNSSDSANSHSSPSMSPQACPFPNLPQPRLASLCPTVTWTCLQLPGPAKWGVGVGQCHTVLSPWNIPQQTWSFQLTFSPVLIAFPGSQMTLRSHAPSPAAVPVFTVTCSFTRLPSSSANLILFCSHNPTG

SEQ ID NO: 785222 - protein, 133 aa, Homo sapiens
PHIKGSNTTEVISGSLNSIKCVFLVWAAFLHVPRTFSSAALPSPGTHCYLCPDCGRMMSVEKTYLPFSLGPETMLIPPLTFHWQEQPVRHTWNGKDGEEISLLVGSHLLELPSLDGLTNSSVSEPVLPQITIL

SEQ ID NO: 785223 - protein, 133 aa, Homo sapiens; identical to SEQ ID NO: 785222

SEQ ID NO: 785224 - protein, 123 aa, Homo sapiens
MAQLPSAQMPAPRTQPDLILVHPVLALSGRAPSILCSVPWDACELLATAMWWKTRILWGVFLISRTRPPAPMQILILTLDPSEGEVCCKKRKPGQTGRNRVRMTTATCKPGGEASGETSPGTP

SEQ ID NO: 785225 - protein, 95 aa, Homo sapiens
VKIGDFALKIGDLGSIKSMDTRRVHTAEGPDFISVLERSQALFSSLGCMFCDDGDDDSGDDDGDNGDDDEYDGDNDDDDIGDDDDSTGDGDDDGA

SEQ ID NO: 785226 - protein, 47 aa, Homo sapiens
MFCDDGDDDSGDDDGDNGDDDEYDGDNDDDDIGDDDDSTGDGDDVVH

SEQ ID NO: 785227 - protein, 42 aa, Homo sapiens
CKSYLTSSNLNHRDMHVSCINTRKNTLAREWTVTGLRMISPS

SEQ ID NO: 785228 - protein, 114 aa, Homo sapiens
GNVPSRLSDKGPPQRLKPASLQFSCPDCRWVLCPGAWDALSSRVNRCQSCALQGRPQEGGSSRDTAYSAHQARKGLFPTSDPPSVDHPGLAWRGNLKFCALILTASLGFLWTFR

SEQ ID NO: 785229 - protein, 52 aa, Homo sapiens
MVTITAPGLRDAHSQVDSHSLTCCGLLGDGTACLLCSSLRLAPCSTEKPFSL

SEQ ID NO: 785230 - protein, 55 aa, Homo sapiens
LATPHGTWHSESALLASPHGTRHSQSALLASPPRLPTWRPTLTVGPPGIPTGAAR

SEQ ID NO: 785231 - protein, 99 aa, Homo sapiens
YQLSVSRSLGEEQFSVGSVNFMKQTNIQKNTNTRDTSKKTKDQLIIDAGQKHFGATVCKSCGMIYTASNPEDEMQHVQHHHRFLEGIKYVVSQNIVFQF

SEQ ID NO: 785232 - protein, 80 aa, Homo sapiens
RQGLGPGRPPWGQELGLERPLGGKSGACRGCSPTSAGPVQATGRQELSPKMLLGGQSRAWRRSREEELGPVFHFWQPLGL

SEQ ID NO: 785233 - protein, 27 aa, Homo sapiens
MLVRLVLNSWYQVICPPEPPKVLGLQA

SEQ ID NO: 785234 - protein, 247 aa, Homo sapiens
MIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVLAALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWTRPKMSLAQKKDRVAQKKASFLRAQERAAES

SEQ ID NO: 785235 - protein, 153 aa, Homo sapiens
GRTQRCTQASARPFLQDPALHSSLSRALPAELQGHQAGDGSQRLRSPTAQALPVTTSASLSWDQRPHLCSPQPGSAGPVLRPLQTRGLWPPDYSLALGCLGAAGTHPGSLPPAKPTVPPRCLTYCCAVGGIITTSGHAMTLLLICKIKRVWQQ

SEQ ID NO: 785236 - protein, 119 aa, Homo sapiens
QGGLLITAKWGKKFRLSPVAMETCLLTWPSLTPTHGSETCPVRGFGGRGGKEQFLSLCLAGVAWGCRKSSVCGGCTFGPLAREQSLVRISRLLASLSPFLGYMCQIKQNETKTREHTVI

SEQ ID NO: 785237 - protein, 39 aa, Homo sapiens
MLPKFNPNEIKFVYLRCTRGEGGATSALAPKIGPLGLSP

SEQ ID NO: 785238 - protein, 225 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTNLQKGSQKRAISTPGNPPNKKECVNLVGPHQLLSPSRFSPSANPSQKYNSTKVTRGPKGYLLRLSHKDVSGLGQGGVGTHKPKASDVRGPTGTLNPVQTPQTIERPDTYND

SEQ ID NO: 785239 - protein, 32 aa, Homo sapiens
MAWRGVCSGSPLNSFSSRNHAEENSEDGFPET

SEQ ID NO: 785240 - protein, 69 aa, Homo sapiens
SSPPQKEVGKRRKSGKLGRLILKFIWRNKHVRPAKKLLKKNEDELALSDINTQYKAEPGKLCMKGQIVN

SEQ ID NO: 785241 - protein, 104 aa, Homo sapiens
ENCLNSGGGGCSEPRSCHCPPALGDRARLRLGEKRKNCLTSFLTLHGLSASLFTSVTSNANGLHQIYSSLRTPLCSYCPCLASLLSSLIDTELTFCLILQTWLF

SEQ ID NO: 785242 - protein, 88 aa, Homo sapiens
APEEKGRVARGSGPQRPHSFSEALRRPASMGSEGLGGDADPMKRKPWTSLSSESVSCPQGSLSPATSLMQVSERPRSLPLSPELESSP

SEQ ID NO: 785243 - protein, 596 aa, Homo sapiens
GGPSERTPGAAARGEVRRSGACISRYAKKPFHPDVLRDNMDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKIYPLHELALWQPLHADSGFSKISKTFSFYKLETWLRSCLTGNPFGTSACLKSGKKLAWAHQVEGTTKRAKIACNTHVAPRMHRLVVMSQVYKQTLAKSSDTLAGAHVKIHRCNESFIYLLSPLRSVTIEKCRNSIFVLGPVGTTLHLHSCDNVKVIAVCHRLSISSTTGCIFHVLTPTRPLILSGNQTVTFAPFHTHYPMLEDHMARTGLATVPNYWDNPMVVCRENSDTRVFQLLPPCEFYVFIIPFEMEGDTTEIPGGLPSVYQKALGQREQKIQIWQKTVKEAHLTKDQRKQFQVLVENKFYEWLINTGHRQQLDSLVPPAAGSKQAAG

SEQ ID NO: 785244 - protein, 328 aa, Homo sapiens
GGPSERTPGAAARGEVRRSGACISRYAKKPFHPDVLRDNMDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKIYPLHELALWQPLHADSGFSKISKTFSFYKLETWLRSCLTGNPFGTSACLKSGKKLAWAHQGIF

SEQ ID NO: 785245 - protein, 415 aa, Homo sapiens
GGPSERTPGAAARGEVRRSGACISRYAKKPFHPDVLRDNMDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKIYPLHELALWQPLHADSGFSKISKTFSFYKLETWLRSCLTGNPFGTSACLKSGKKLAWAHQVEGTTKRAKIACNTHVAPRMHRLVVMSQVYKQTLAKSSDTLAGAHVKIHRCNESFIYLLSPLRSVTIRFFSQVRRLRFVSGTGPLFANQR

SEQ ID NO: 785246 - protein, 192 aa, Homo sapiens
GGPSERTPGAAARGEVRRSGACISRYAKKPFHPDVLRDNMDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLNKVSLRTSLIGEEWPSPRNKSQSPDLTEKSNCHNKVLLIS

SEQ ID NO: 785247 - protein, 135 aa, Homo sapiens
GGPSERTPGAAARGEVRRSGACISRYAKKPFHPDVLRDNMDQSRVLLWVKAEPFIVGALQVPPPSKFSLHYLRKISTYVQIRATEGAYPRLYWSTWRHIACGKLQLAKDLAWLYFEIFDSLSMNSRRPEFRLSLG

SEQ ID NO: 785248 - protein, 634 aa, Homo sapiens
YSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQCSVSCGRGTQARYVSCRDALDRIADESYCAHLPRPAEIWDCFTPCGEWQAGDWSPCSASCGHGKTTRQVLCMNYQQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 785249 - protein, 307 aa, Homo sapiens
ASRAGCSARKWTLHLRRRREAQRHLQDVTAHQDLLVPLEDPDSQGQRCHWDAWTCGVPRRRWAVHHWSPRPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGYQATRRKGERGMPGMQAEHGAKGAPGIADGWMKGEPRKSQGTKGEKGAEGSPGLLGSGGSRGEDRRCWPTQLEEGEGNWPQGPGPQAKENRGRGSWPQGAEKGRDAVEKG

SEQ ID NO: 785250 - protein, 93 aa, Homo sapiens
PGSRSRFSHHTSLQAERSGSGLGQPRKGLPQCSGGLKGSSSAAKVGAQAEEAPRASEGCEDCQHAVTSQNYLLRMSEETVLLCCPGRSGVAQS

SEQ ID NO: 785251 - protein, 109 aa, Homo sapiens
MASEAPSPPRSPPPPTSPEPELAQLRRKVEKLERELRSCKRQVREIEKLLHHTERLYQNAESNNQELRTQVRGPPQPRAPSSPGEAFEARDSLGRGPWQGLRTTVEYLK

SEQ ID NO: 785252 - protein, 714 aa, Homo sapiens
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQEPASALATEDTSLEGSSLAESLRAAAEAAVSQTGFSYDENTGLYFDHSTGFYYDSENQLYYDPSTGIYYYCDVESGRYQFHSRVDLQPYPTSSTKQSKDKKLKKKRKDPDSSATNEEKDLNSEDQKAFSVEHTSCNEEENFANMKKKAKIGIHHKNSPPKVTVPTSGNTIESPLHENISNSTSFKDEKIMETDSEPEEGEITDSQTEDSYDEAITSEGNVTAEDSEDEDEDKIWPPCIRVIVIRSPVLQIGSLFIITAVNPATIGREKDMEHTLRIPEVGVSKFHAEIYFDHDLQSYVLVDQGSQNGTIVNGKQILQPKTKCDPYVLEHGDEVKIGETVLSFHIHPGSDTCDGCEPGQVRAHLRLDKKDESFVGPTLSKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 785253 - protein, 587 aa, Homo sapiens
MPLSIETSILNSKDHLQVENDAYPGTDRTENVKYRQVDHFASNSQEPASALATEDTSLEGSSLAESLRAAAEAAVSQTGFSYDENTGLYFDHSTGFYYDSENQLYYDPSTGIYYYCDVESGRYQFHSRVDLQPYPTSSTKQSKDKKLKKKRKDPDSSATNEEKDLNSEDQKAFSVEHTSCNEEENFANMKKKAKIGIHHKNSPPKVTVPTSGNTIESPLHENISNSTSFKDEKIMETDSEPEEGEITDSQTEDSYDEAITSEGNVTAEDSEDEDEDKIWPPCIRVIVIRSPVLQIGSLFIITAVNPATIGREKDMEHTLRIPEVGVSKFHAEIYFDHDLQSYVLVDQGSQNGTIVNGKQILQPKTKCDPYVLEHGDEVKIGETVLSFHIHPGSDTCDGCEPGQVRAHLRLDKKDESFVGPTLSKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 785254 - protein, 176 aa, Homo sapiens
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQVIKC

SEQ ID NO: 785255 - protein, 399 aa, Homo sapiens
MKKKAKIGIHHKNSPPKVTVPTSGNTIESPLHENISNSTSFKDEKIMETDSEPEEGEITDSQTEDSYDEAITSEGNVTAEDSEDEDEDKIWPPCIRVIVIRSPVLQIGSLFIITAVNPATIGREKDMEHTLRIPEVGVSKFHAEIYFDHDLQSYVLVDQGSQNGTIVNGKQILQPKTKCDPYVLEHGDEVKIGETVLSFHIHPGSDTCDGCEPGQVRAHLRLDKKDESFVGPTLSKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 785256 - protein, 311 aa, Homo sapiens
MTSELDIFVVDTDPYLTRTCIASGSMCYSCDLTRWPCVVRSCESWSRLCATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGAVGEAPTDPDSQMDDMDMDLDKEFLQDLKELKVLVADKDLLDLHKSLVCTALRGKLGVFSEMEANFKNLSRGLVNVAAKLTHNKDVRDLFVDLVE

SEQ ID NO: 785257 - protein, 87 aa, Homo sapiens
CKAGGPDLSASLWHLPPVPSEPQVAHSGLPASTSFFAFGPRLSGEFLTAVPQGCLPQKPSCGREDKEPPTYNEELAVKLWGERYWRE

SEQ ID NO: 785258 - protein, 216 aa, Homo sapiens
KPYIFSDAQRPSSFGSKGTFPHHDIATSVAAVCISLPVRTDHIAQEIHSAESRDHSQTAGRTLTSSSPDSKVTEEGRAQTLLPGRPSSGQRISDSVPLESTEKTHLEIPASGPSSASSHHKEGRHKTFFPSRGQYGCGEMTVPCPSLGSDGRKRQVSGLITRKDSVVPSKPEQPIEIPEAPSKSLKKRSLEGMRKQTRVEFSDTSSDDEDRLVIEI

SEQ ID NO: 785259 - protein, 123 aa, Homo sapiens
VEFLIWFSAWWLLVYSRATHLCTSILYPKTLPNSFTSYRSFLDEFLGFSRYMIISSANCNTLTSSLPLWMLLISFSCLIVLARTSSSVLNRSGESGHPCLVLVLRGNALNFSLFSVMLAVGLS

SEQ ID NO: 785260 - protein, 156 aa, Homo sapiens
MQGSNLEEERKEVRNGPYSGTLEIHGCGIEFSQEECKWLDLRRGIYTKDVMSADFIGHLVSLGNPVLPDLKGTFQGVGGKKEEIPGLWQSGRENRPRSEGRLGSRCDQEPFVTSQRPSSEALVTSGASSGNNGHVQLGRHRGTWITDRSLMQLTDR

SEQ ID NO: 785261 - protein, 119 aa, Homo sapiens
RLAQGTCEGEKSDLEYKLPQHNWPQDCGCFQKTLPSCVELTYSGALGRGVCEHGGHGVRWPPPFRLTAQPVSSLLLCTWRRQGRQGCCLPEGVQSVNKTSPLDLSGESRLGLFETRYMV

SEQ ID NO: 785262 - protein, 246 aa, Homo sapiens
PRRPRPLWLDPETSHGGHPHGNMPGLDRPLSRQNPHDGVVTPAASPSLPQPGLQMPGQWGPVQGGPQPSGQHRSPCPEGPVPSGVPCATSVPHFPTPSILHQGPGHEQHSPLVAPPAALPSDGRDEVSHLQSGSHLANNSDPESTFRQNPRIVNHWASPELRQNPGVKNEHRPASALVNPLARGDSPENRTHHPLGAGAGSGCAPLEADSGASGALAMFFQGGETENEENLSSEKAGLSGQADFDD

SEQ ID NO: 785263 - protein, 81 aa, Homo sapiens
MPVAHGPAVGGAGLGMAPLGLAFGCGLAVAFQPGAGSALPSEAGEGGGEAGRGERRGGLRADWHRRSPGQPRDYQALCRGR

SEQ ID NO: 785264 - protein, 74 aa, Homo sapiens
HTHPFSMCSLENRTNSSLQRTNTQAQWSPKAMLLILNHLRTLLKCRFWLRSSLVGLRVCIFNKLPGTTPVDTNS

SEQ ID NO: 785265 - protein, 133 aa, Homo sapiens
EPQEWSRRSCSRRPCFLLARKSRNDRNRHPRLRPRGAPLRMAGGPAGLLREGIREAEAGEGCEVARGGASRSGATHHTNSLPFPRKSGRGKTRASSGGSPGLWEPGEDRKAEGSAADKPSAPPGRHWWPRGRW

SEQ ID NO: 785266 - protein, 174 aa, Homo sapiens
QAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEELEEKHREAQVSAQHLEVHLKQKEQHYEEKIKVLDIR

SEQ ID NO: 785267 - protein, 56 aa, Homo sapiens
MKCLTSYPDPGQCQPPRPQPLTHLLQLVAAALYVEPPLSPGRLSCYAALLIFKTIL

SEQ ID NO: 785268 - protein, 80 aa, Homo sapiens
VFAKKKVLPLFTPSCVNGTANALAYCDWTRILTCSCSFPSYGCSQIRPLHRTQSWQLLPGPLQRPVQSSTLAPCLYQSRN

SEQ ID NO: 785269 - protein, 139 aa, Homo sapiens
LVRHKAGEVGSAPEDRRFGSLSYCQKNDVGGHIHLPRCRCDAVSTNWFVGEQTLPQALFEFLTLYTFSELFLPLSSCHFLFYRFHPGCVDARSTQCPGSNFTQDTLRTGFKYDPNLHNPNSAGLSCQVEVGIVASEDLN

SEQ ID NO: 785270 - protein, 51 aa, Homo sapiens
PRLSRHVQQWGVAAQGSPHEATGLHRGSAQGSKAAWVLTWHSGSTQLPPAK

SEQ ID NO: 785271 - protein, 72 aa, Homo sapiens
SDMISARSNIWYYHLDQQLRVELPGCRALGLRDHRSGPPGPRGHPLGPQSGRYQLGNLRQVANLSKLVFPCL

SEQ ID NO: 785272 - protein, 111 aa, Homo sapiens
RNNTRCLLKTTVLSFMQCFCTETAVSCQCTVNGRKTNKMSFQVFLRDGFGTLKTPMASTIKETRNPGERQKAVRTGRDLHSRGRQAHQSGRKEQALLLVSQHTWQAQGSRW

SEQ ID NO: 785273 - protein, 208 aa, Homo sapiens
TCAPLATLVLAPEIPKSVPSPSLPPAGTPPGTKKVDGISHTSALAPVASSPKECPTEDSGASATASSKGTLTYLADSPSPLGVSVSPQTKRPPTKKGSAGPDTPIGNLSSPVSPVEASFLPENSLSFQGSKDSPATTHSPTPPSPKGAPTPSAVTPLSPKGVTLPPKETPTPSVVNLPFPKEGPATPAPKQAPALSMTSSSPKKARAT

SEQ ID NO: 785274 - protein, 155 aa, Homo sapiens
CVLVLVVLVLVELPQCEIKCKPISLQTTSVVWFFAGRTMVNLLKHSLIRHPESSQFLDLLYLFFSFCYSFSFSIHPKPYPGHHQSFYTTNVSSNNPTISPLTTRPPFSLISPTLGSHAAPIPLEAALRNIAHSLSISPPKNFHRPNTSTPFCFIF

SEQ ID NO: 785275 - protein, 102 aa, Homo sapiens
QIMESLKYQCDEIFEHPVSKSVFNFFKRMYLVIVCSGGDTSLNKQAASQSARYSLVLILFSLTATILAQCFITSFLDYVKSPDQVLTFKYYLFWNIWKQCIK

SEQ ID NO: 785276 - protein, 76 aa, Homo sapiens
RAIGEVESGVAGSMSGTQTYSQRMGYSVEKYRRRGNGTRLIMRCMKYLCQKNIPFYGSVLEENQGVIRKTSALGFL

SEQ ID NO: 785277 - protein, 117 aa, Homo sapiens
GTATEEQAASKPGSASLLCVWKNKAASEPGASCWLLYSDPPPLSREANFLRRKEKHQLLVPHPGTPGLVVRVAYTEQACSPFSFALQPEACLPSSLGHRHPEQPFLPPLPTSPALGF

SEQ ID NO: 785278 - protein, 40 aa, Homo sapiens
PWGNAFSKILLQAPSGTYSPLWSGCQVHGGGIHLFQMPAD

SEQ ID NO: 785279 - protein, 131 aa, Homo sapiens
MAINQSPFSSGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 785280 - protein, 194 aa, Homo sapiens
NLGLGSEAWAGWLLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAMRLPGSVGTPLPGVQVRIVSENPQREACSYTIHAEGDERGTKGPSPCCCPDMPLLGFLPLPCWY

SEQ ID NO: 785281 - protein, 284 aa, Homo sapiens
GPARLTTPRDPAGTRPDPGARAAEDEEECGEADPAPWPRPSREVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAMRLPGSVGTPLPGVQVRIVSENPQREACSYTIHAEGDERGTKVTPGFEEKEGELLVRGPSVFREYWNKPEETKSAFTLDGWFKTGRTQPHGS

SEQ ID NO: 785282 - protein, 311 aa, Homo sapiens [sequence omitted]

SEQ ID NO: 785283 - protein, 275 aa, Homo sapiens
QEAGGPLLPLTPAIYTGAVEEPAEVPVPEQEWRNKGAMIIYTSGTTGRPKGVLSTHQNIRTVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAMRLPGSVGTPLPGVQVRIVSENPQREACSYTIHAEGDERGTKGPSPCCCPDMPLLGFLPLPCWY

SEQ ID NO: 785284 - protein, 190 aa, Homo sapiens
GPARLTTPRDPAGTRPDPGARAAEDEEECGEADPAPWPRPSREVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRFRGDPTAWSTGAHCLRKPTEGSLLLHHPRRGRREGDQGKPLCS

SEQ ID NO: 785285 - protein, 416 aa, Homo sapiens
QEAGGPLLPLTPAIYTGAVEEPAEVPVPEQEWRNKGAMIIYTSGTTGRPKGVLSTHQNIRTVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAMRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 785286 - protein, 137 aa, Homo sapiens
KRKKEKCDLEMWRSRLTATPRSKPVAPGERETGLGRLPPLSREAYGQGQVGRGTVLGLWPRLDGRRHFLHKKRQETTTLGFWTFPRNSNQNNRHEGSFLSWLSAAWTPWTSPSCAWATAAAFRASLVGGTTILPLGG

SEQ ID NO: 785287 - protein, 132 aa, Homo sapiens
MSWPRTRCPRSWCWWRRSRGTRWARLTRRRSSGTSTPHDPADWDCGSGGEQQTSPSHREPRGPVQDLASLKPEPPKSGHVESRTVWDEITMWGPQPRASCCSSRRPSLVSPLPGHRRPHLCSAVQPAPGPTC

SEQ ID NO: 785288 - protein, 132 aa, Homo sapiens
GCTTGTPEQGPKQGTPARMPNPRGSGSCWGAVVPVSGGLMRAAPTSSAGFQPQLPHTRAVPSRPPRPDKAPAAKVLRGEGFLGFLKPVFPIVSYVPAEASTVPGPAAHSVSRVCTWHPSFWKSTNNGLPAED

SEQ ID NO: 785289 - protein, 56 aa, Homo sapiens
MIISIDAEKVIDNIQHHSMIKSFNQLHIEEMDRNTIKVICDKPAADIIPNGEKLKA

SEQ ID NO: 785290 - protein, 263 aa, Homo sapiens
PGFWVTAFLNHPQLSAMISPRDEDMLCYLMNLEVRELRHSRTGCKFKFRFWSNPYFQNKVIVKEYECRASGRVVSIATRIRWHWGQEPPALVHRNRDTVRSFFSWFSQHSLPEADRVAQIIKDDLWPNPLQYYLLGDGPAEPGEASQGGPRRPLLGPTGSSLAKCCLGMCGLHKLPHASYGWRIWAQAHGGRSVVCCLLSAVCCLFCALPLCVVRWTQLSNCGPRGQSLLFPYGLLLFCVNITWLSHAAASTLSTQCCGCALP

SEQ ID NO: 785291 - protein, 105 aa, Homo sapiens
LSDNLRTSGASTRFTQQLRGPEKKHRMVWQEKEDMHKQLVEASETLKSQAKELKDAHQQQKLALQEFLELNELMAELYSQKQKVWDKEEEMEVAMQKADMMWQEI

SEQ ID NO: 785292 - protein, 95 aa, Homo sapiens
FLLDEFKLYRNISYIHKGEGKRWNMRRGLFQIRPILQKLSSLLHKERRLLLQGFWSHQNPQTGPTEKAFTETTEDKPNNMANRRYTTKSSHCNIN

SEQ ID NO: 785293 - protein, 98 aa, Homo sapiens
FLLDEFKLYRNISYIHKGEGKRWNMRRGLFQIRPILQKLSSLLHKERRLLLQGFWSHQNPQTGPTEKAFTETTEDKPNNMANRRYTIPCVCVENDRVL

SEQ ID NO: 785294 - protein, 281 aa, Homo sapiens
HQCSGGGPGGPGMGNCGGFRGGFGSGIRGRGRSRRRGRGRGRGARGGKAEDKEWMPVTKLGCLVKDMKIKSLEEIYLFSLPIKESEIIDFFLGASLKDEVLKIMPVQTQTRAGQRTRFKAFVAIGDYNGHVGLGVKCSKEVATAIHGAIILAKLSIVPVRRGYWGNKIGKPHTVPCKVTGRCGSALVHLIPVPRGTGIVSAPVPKKLLMMAGIDDCCTSAWGCTATLGNFAKATFDAISKTYSYLTPDLWKETVFTKSPDQEFTDHLIKAHARVSVQRTQA

SEQ ID NO: 785295 - protein, 262 aa, Homo sapiens
MPQKMSCSASKLWSCLLSRPGIPWSAPPGRAQPYYSASVPGHQHLHPSQSVWGGCKPRGFSSVWSFCAMVGLLILPHHPFGLPHTCPFPGITCVSSLSPFYCNGGLCPGKSRPDGCTGEPHSWMSAQPSNWEEQRLSSSLTPDTRPQWACTGPQKVSLGFAFLVSITVKEALIEQLQCTWSSASAGHLEIGTVMVPALKELMTWWGPVVFKEPRSHWAPKVELKDWGQLALSLPPLHCLPLKNPTPPHDGPLCSPCISVTVN

SEQ ID NO: 785296 - protein, 110 aa, Homo sapiens [sequence omitted]

SEQ ID NO: 785297 - protein, 180 aa, Homo sapiens
MLELNREVTGNTKSGEGGGEAASLAGFGWASGVNSQYREEVSRCRGQPYRVCEFFSPCVETGDCRNKDTRQKDKRQLGPGDNYHQDVETSSIPECQTVLLFIGYKTRGQGKECEPSPMIGKVTWVTCPLDRGPFPVWQPRWRERGETAYAIISAFQRLLILSVILLLVSRRQSQVYRVDT

SEQ ID NO: 785298 - protein, 249 aa, Homo sapiens
KYEEAYRLLFQSRGGGLVDIMYSWLHLASEEMVGGWSRWLISISCPLLPLSRTRAVYRQSHSKYIIQERMLELNREVTGNTKSGEGGGEAASLAGFGWASGVNSQYREEVSRCRGQPYRVCEFFSPCVETGDCRNKDTRQKDKRQLGPGDNYHQDVETSSIPECQTVLLFIGYKTRGQGKECEPSPMIGKVTWVTCPLDRGPFPVWQPRWRERGETAYAIISAFQRLLILSVILLLVSRRQSQVYRVDT

SEQ ID NO: 785299 - protein, 238 aa, Homo sapiens
LVRHGGGAQYDYMVTLASEEMVGGWSRWLISISCPLLPLSRTRAVYRQSHSKYIIQERMLELNREVTGNTKSGEGGGEAASLAGFGWASGVNSQYREEVSRCRGQPYRVCEFFSPCVETGDCRNKDTRQKDKRQLGPGDNYHQDVETSSIPECQTVLLFIGYKTRGQGKECEPSPMIGKVTWVTCPLDRGPFPVWQPRWRERGETAYAIISAFQRLLILSVILLLVSRRQSQVYRVDT

SEQ ID NO: 785300 - protein, 242 aa, Homo sapiens
VDLRRSYYARVLPENLSQMKWVVGGSLYGVDYGILCAHVVTILAGLTAVYRQSHSKYIIQERMLELNREVTGNTKSGEGGGEAASLAGFGWASGVNSQYREEVSRCRGQPYRVCEFFSPCVETGDCRNKDTRQKDKRQLGPGDNYHQDVETSSIPECQTVLLFIGYKTRGQGKECEPSPMIGKVTWVTCPLDRGPFPVWQPRWRERGETAYAIISAFQRLLILSVILLLVSRRQSQVYRVDT

SEQ ID NO: 785301 - protein, 159 aa, Homo sapiens
VTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYEAPDISL

SEQ ID NO: 785302 - protein, 72 aa, Homo sapiens
HLAVAQGASATAGHMSATAGHTPLPDPSPGSGTGSISHGRSHPTPPEPVPNGGTPGGKTATWSATIPPQTVS

SEQ ID NO: 785303 - protein, 110 aa, Homo sapiens
LALHPPHPSLTGCSWKAQEEHKDPTGDSSPTAFHPRLCSHHTSLFKNLHQRLGMVAHACNPSTLGGQGGWIMRSRDRDHPDQHGETLSLLKIQNLLGVVVHACNPSYSGG

SEQ ID NO: 785304 - protein, 54 aa, Homo sapiens
EIQKVIQDDYEHLYAHKLENVEETNKFLETYNPPILNQEDTESLNRPITSNKTE

SEQ ID NO: 785305 - protein, 100 aa, Homo sapiens
MTHEPPKMHRERCLPPPQAPVHEVTSVQNTEVNEMSVAGSSGIYRLHEPISLQYQSSTTEFAEQQHEIAEQHQEFAEQHHSSTTEYAEQHHEFAEKHHEF

SEQ ID NO: 785306 - protein, 102 aa, Homo sapiens
MNMEGLVMFQDLSIDFSQEEWECLDAAQKDLYRDVMMENYSSLVSLGLSIPKPDVISLLEQGKEPWMVSRDVLGGWCRVELESCFVTQAGLEFLSSSNLPTL

SEQ ID NO: 785307 - protein, 116 aa, Homo sapiens [sequence omitted]

SEQ ID NO: 785308 - protein, 123 aa, Homo sapiens
QPLPLGFKRFSCLSLLSSWDYRHAPPRPANFIFLVETGFHHVSQAGLELPTSGDLPASASQSAGITGMSHRAWLYLGFFACFVFGLHNTWDYAVFFSLSVWPISLGIVFSRFYKGEFYGMRIF

SEQ ID NO: 785309 - protein, 101 aa, Homo sapiens
HFSPCGSIRSKVDIQWTSSVVEMSKFSTVRLDVASAHAPESPPSHLLILLFQAPLDPAKKVLTIGTLTTTPPKPNICSDLSVSRQYLGLNILKRHPSFYQV

SEQ ID NO: 785310 - protein, 50 aa, Homo sapiens
QVNTHMHVGTGRYHRGPDEWHTPALHPHSVLGCPKNKHSIGDKWVQTYTS

SEQ ID NO: 785311 - protein, 158 aa, Homo sapiens
PPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELSTATCGAETVICPSALFQKMPSNPFHPIP

SEQ ID NO: 785312 - protein, 154 aa, Homo sapiens
PPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVSVAEVWVRGGKKEGTVPYSVSLFLPSLLCRHSRWAAVYGPLLLFKVSGIFLQRLIP

SEQ ID NO: 785313 - protein, 126 aa, Homo sapiens
MITVLENTIKEPQRQKYLEELKAKSHKLTLLSSELEQRASTIAYLTSQLDAAKKKLMSSSGTSDASPSGDPCWPATSQRPPKTSYPKRLAAAKKSLSAPLHPEFEEVYRFGAESRKFFCGNSGCYA

SEQ ID NO: 785314 - protein, 77 aa, Homo sapiens
MKVLWMSAWQPQTWRTSCTAHRRTSLLETLVTSRAPPGDPCHLLTNLSQGGTITEQPCVYLKELNKMTLLLIAPLPK

SEQ ID NO: 785315 - protein, 173 aa, Homo sapiens
EAVSGKVSLPTGRPPRFPQAGSGVSAMRLPPGLSTPANKCLIRGLYPHWTVSSRRAWVVSCSSWCPSDQHKGRKKEKEERRKFQVRRDSFFPEFPASDFLLCPAARKKQNRRTSTGLGVVELGTYICASLWASPFSLGLPLLICTMEMSMPSLPTSPSLCESKAETHLGLCKL

SEQ ID NO: 785316 - protein, 54 aa, Homo sapiens
MAGSRAWKPHGSQPLAAAQFPRLHSELVAGREKAQQPGLRVRGLCRGRWSHASG

SEQ ID NO: 785317 - protein, 100 aa, Homo sapiens
NTANAIPIPSPDPHSGADTDTAKTASAIPSPSPDCPSSIPGNHEPFLNFRIFSPHKCDIKRTTQYAAFGGCLPTLRSSRRCVPVVLLLGGVPWYGHSSVC

SEQ ID NO: 785318 - protein, 292 aa, Homo sapiens
AAVWHHLFHLLLLPPSRHPPSTRFSPVVLAPWTRFLRQTVPLKVGDSLFWVHCSPTGSLPSAIMNIRNAQPDDLMNMQHCNLLCLPENYQMKYYLYHGLSWPQLSYIAEDEDGKIVGYVLAKMEEEPDDVPHGHITSLAVKRSHRRLGLAQKLMDQASRAMIENFNAKYVSLHVRKSNRPALHLYSNTLNFQISEVEPKYYADGEDAYAMKRDLSQMADELRRQMDLKKGGYVVLGSRENQETQGSTLSDSEEACQQKNPATEESGSDSKEPKESVESTNVQDSSESSDSTS

SEQ ID NO: 785319 - protein, 58 aa, Homo sapiens
PLFPFKSSHQSTECFADPEPAPIDHPVGAPEAQPGAISKGLWRGALDRTAPGDRCSIS

SEQ ID NO: 785320 - protein, 128 aa, Homo sapiens
CRMEAAEQNEAAGQGRRQRRVRNARSHSTCHCSMHPHRCYALGDLVISERQINSKTGFHPVVLGFVCYYLLICVFAKVVSREVNMNLSLENPGRESWHLGNPCLILVVGLGSRIQIHACLHVKSRCPG

SEQ ID NO: 785321 - protein, 86 aa, Homo sapiens
VPGLETADVCPGEGPSRMLRRRQQMFCSQADPSVPQPGLAFLSRPQGDVSRNHSQCGWAPCSARSLSAEQASSPEQRPSLLERWVV

SEQ ID NO: 785322 - protein, 81 aa, Homo sapiens
QGGGLQREENLQAVSDLDTPFHLLEEGMGLGTWLGAINHQSGSKTCHTRPGGLEPGWGSWSLRCGLVTDVLCRVSRKEPSP

SEQ ID NO: 785323 - protein, 143 aa, Homo sapiens
DVGGISLWTTALNQMPLCQAGMLCLRFPLLKLPYEGVVRQLFPANTPIPRLQAGTLRPLFYFIAVFNHVPTFDLVMPGHLPEILSHDLWIAQLAAAPILSCSDSGALQRTECSFLPGVKIGPVEVVCFLGSTLPTKNTWACRF

SEQ ID NO: 785324 - protein, 398 aa, Homo sapiens
RAVRGKGPRTRRSRRAGQCWPLAERWGSMKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNCPSRTVSPAGPSSTQLVPPLLRAPARVLGEAVSAFSPALAEVTLGIGLAQGHPAQYHEEEADSTAKAMVTEMCLGEEDFQQLQAQEGVAITFCLKEFRGLLNYAESENLNLSIHIDVQSRAANFTIKDSLLDGTLSWHTLRHDSHSQELGPQSVTSQWLSSGLTEQPNLDEFGNDDLTLHDRHGNTIGKEVRGAASSSGGASAKRPGPQRRKGALGGAPQNGCGQGEDTGAGERAPLIRDGDRVPQE

SEQ ID NO: 785325 - protein, 226 aa, Homo sapiens
MKSFLSVFRSLAMLEKTVEKCCISLNGRSSRLVVQLHCKFDSTAKAMVTEMCLGEEDFQQLQAQEGVAITFCLKEFRGLLSYAESENLNLSIHIDVQSRAANFTIKDSLLDGTLSWHTLRHDSHSQELGPQSVTSQWLSSGLTEQPNLDEFGNDDLTLTYRHGNTIGKEVRGAASSSGGASAKRPGPQRRKGALGGAPQNGCGQGEDTGAGERAPLIRDGDRVPQE

SEQ ID NO: 785326 - protein, 434 aa, Homo sapiens
EQKHPMAKDGVLTLANNVTPAKDVPPLSETEDDTSSKLNDMEIAQSTEKEYSEDSHLESLQDVGQSADTYFHDFTMKPSHGTGKRVHACRAEEDSVLEKLGEHGNHATVNLLTLSSDDSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKPQQLLLLPQLAQAVGAPSTLLPKKPTAIKTEGKPAEVKKMTAKVMYQQTLSRHKEHLQQFHEENHHYSDGTAPAAGVVPSRVKATTQCPPRHIHKTIYIDKKHKLRHKPQTNQNTGSNGHGHQKTEPDPKNDRPKDKSEQERDTKGPQMTATENHKTWEECRRNKDTEAKQE

SEQ ID NO: 785327 - protein, 42 aa, Homo sapiens
MVTGRQRDSKSVSFKNIFLCEATILNPEQFFLLGFLLIFHTS

SEQ ID NO: 785328 - protein, 576 aa, Homo sapiens
MNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRRCTRLEMPDNLYTFVLKVKDRTDIIFEVGDEQQLNSWMAELSECTGRGRLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 785329 - protein, 161 aa, Homo sapiens
RATASARLPARTVAARGGDGGRCKVSPAAAARGRILPQLSSAGGGNDEALAIFRARVSCLSPARASRERGAGGRERTRPGRGPARPLGISRARGRATPWAGRAQSSCLSGEPAFARAPLLRGREGFCGERGGPVSSSARALRVTPSPKYCPAANSDGGVPG

SEQ ID NO: 785330 - protein, 309 aa, Homo sapiens
MPDNLYTFVLKVKDRTDIIFEVGDEQQLNSWMAELSECTGRGRLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 785331 - protein, 576 aa, Homo sapiens; identical to SEQ ID NO: 785328

SEQ ID NO: 785332 - protein, 110 aa, Homo sapiens
ERVGRPTRRHQPPCLANFVFLVETGFHHVGQAGLECLTSGDPPALASQSAGITGASHRAQPTPLLVPTLLGDFMDPKADLTLIQICSPFLRTPVFISSKSSSFLWKMNAN

SEQ ID NO: 785333 - protein, 327 aa, Homo sapiens
MNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKWPEPELSRLRFRLKQGLSCAHVPTRCNLAGASGIGHPYHQVAVADPGSDTWQAWVEIVALGLGGSQGLLWGVGEEPLGCAQPA

SEQ ID NO: 785334 - protein, 63 aa, Homo sapiens
MPDNLYTFVLKVKDRTDIIFEVGDEQQLNSWMAELSECTGRGLESTEAKTPKEQRPQKSKDPK

SEQ ID NO: 785335 - protein, 609 aa, Homo sapiens
CVMGPTPACPPAYSLSPPHPRVFQPGRTTWVSAMNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRRCTRLEMPDNLYTFVLKVKDRTDIIFEVGDEQQLNSWMAELSECTGRGRLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 785336 - protein, 80 aa, Homo sapiens
IARYELLCTSAEGGLSPEGLPGRSSPPEQIFHLVPSPEELANSLQHLEHEPVNRARDSDYEMDSSSRSHLRAIDNQYTPL

SEQ ID NO: 785337 - protein, 289 aa, Homo sapiens [sequence omitted]

SEQ ID NO: 785338 - protein, 120 aa, Homo sapiens
RGPREVPFPLQAQKCLLQMRGFSRLPVSAPGLSKVLVKSGRFATRPGVRTLGAALPCQPPAASAPSRLWVPTSTGRKAERGLQVPHGTDSQGIAVDKPVNGSRRQIGSRVERGGPGEAPL

SEQ ID NO: 785339 - protein, 197 aa, Homo sapiens
MFVSTNKSEDNLSYLRNPGVEESNGNSGQDSTTQTPKEEMINPGGCLGLGEKIYDDDSAIILELRIKKLTQNCSTTWKLNNLLLNDYWVHNKMKAEVKMFFETNENKDTTYQNLWDTFKAVCRGKFIALNAHKRKQERSKIDTLTSQLKELEKQEETHSKASRRQEITKIRAELKEIETHKNPSKKSMNPGAGFLKR

SEQ ID NO: 785340 - protein, 177 aa, Homo sapiens
MSWIFLYFRLYYPDTKRRNDYTLEAALVKVKKYMYDDSAIILELRIKKLTQNCSTTWKLNNLLLNDYWVHNKMKAEVKMFFETNENKDTTYQNLWDTFKAVCRGKFIALNAHKRKQERSKIDTLTSQLKELEKQEETHSKASRRQEITKIRAELKEIETHKNPSKKSMNPGAGFLKR

SEQ ID NO: 785341 - protein, 127 aa, Homo sapiens
TPVAPSDSTQITVLLSTCCVAFGKLLCSSSETSSMGQGVMVPSFWVFLRMDWAHCAWKVLAQGWATEALCYLLLFLRSEPFGMESWRKRTNAQGLRAGEEIMIMGWQRTSRHCQTLWALGELFSVGD

SEQ ID NO: 785342 - protein, 81 aa, Homo sapiens
ALGTMAEVESLAAFLREEGPVGRDSEMLLPPFLMPSAKSGTVIPSCLVSHRYPGGELILLQRPWFQTHLRALSRRGGAGPG

SEQ ID NO: 785343 - protein, 575 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 785344 - protein, 589 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGSERFPVALGLEPTLSIVPGQPWEANCPLSQFLSFISLPSRCDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 785345 - protein, 575 aa, Homo sapiens; identical to SEQ ID NO: 785343

SEQ ID NO: 785346 - protein, 629 aa, Homo sapiens
MAQSRLTTTSASQVQAILLPQPPEELELQTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKVGGPSGTGRPKAKAPQMQLIPGSLCQMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 785347 - protein, 345 aa, Homo sapiens [sequence omitted]

SEQ ID NO: 785348 - protein, 272 aa, Homo sapiens [sequence omitted]

SEQ ID NO: 785349 - protein, 547 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKVSEAGPSHLGRQASSQQTPVSM

SEQ ID NO: 785350 - protein, 242 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGKLVAIHPSPACSLALDFAHLAYP

SEQ ID NO: 785351 - protein, 177 aa, Homo sapiens
MQDRLAGRQQSQILYKGAGASKLRKKPQPEVHLARTWLSCRFPPGHQTSKKLVNSVAGCADDALAGLVACNPNLQLLQGHRVALRSDLDSLKGRVALLSGGGSGHEPAHAGFIGKGMLMGLIARQLVYNPSPRQEEQNHIGRPSSARGANARHKWRTHTNTATTKMSESDKIQNWNQ

SEQ ID NO: 785352 - protein, 575 aa, Homo sapiens; identical to SEQ ID NO: 785343

SEQ ID NO: 785353 - protein, 647 aa, Homo sapiens
MQDRLAGRQQSQILYKGAGASKLRKKPQPEVHLARTWLSCRFPPGHQTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKVGGPSGTGRPKAKAPQMQLIPGSLCQMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 785354 - protein, 345 aa, Homo sapiens [sequence omitted]

SEQ ID NO: 785355 - protein, 557 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGELWHHPSPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 785356 - protein, 202 aa, Homo sapiens [sequence omitted]

SEQ ID NO: 785357 - protein, 259 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTVLISIRYRLDL

SEQ ID NO: 785358 - protein, 82 aa, Homo sapiens
HLPINPSETLKIKPFSRLATNPLRFMQEQGRDCPPRALLAGSDLCDSEKLSPGSHSYMKPIHICPTGRCGIRLKTSIKETLE

SEQ ID NO: 785359 - protein, 110 aa, Homo sapiens
MSQRSRLVQEGNWRDGPQRGQGFPSQRGTGTGLRSCCPGKAEGSRVLVSETTCRIEARQWEELPQTTRAGAPQSEQGCCPTPTPTLRLPGWGGQPWRRAVAAAWEKMNLS

SEQ ID NO: 785360 - protein, 171 aa, Homo sapiens
SGLRAQGCAGSQKSSGVRAESADGLTSAAPIGSLARRRPSLARARPIGARGRTRGLGGGGAGPARRGAGSGGSGRDVTGGGRRRPPAAGLQANAPGSGRSRPASRLRRFLLLCLLLLVVLLFLLLLGLPQPLRPCLPRNFPRKFRNSATGLPSGARLPPREPRGSSEGARP

SEQ ID NO: 785361 - protein, 142 aa, Homo sapiens
ESHDHCPVIDRSRGEKSWGFRCHNLTVIQHVTDAKRLPRPPLAASGEICRSEQGRGRQPPCSALTKAHRGHGMSRALISQCQKRVARMRGGSGGQHMGKTPEDAGLEERKSRNIRASFKNLKATWGITVLSFLEVTKQRWAM

SEQ ID NO: 785362 - protein, 204 aa, Homo sapiens
EGCYEEYRGRSPDAHSGGRNSSSNSYGQSHHYGGEGRYEEYRGRSHEARSGGRSTDAHSRGRSDDAYSGGHDSSSWSDCCGGGGRYEEYQGRSLDANSGGCSPEAYSGGHDNSSWSDRYGVGGHYEENRGHSLDANSGGRSPDTHSGGHSSSSNSYGQSHRYGGEGRYEYRGRSHDAHSGGCSADAYSGGHDSSSQSNRYGGGG

SEQ ID NO: 785363 - protein, 35 aa, Homo sapiens
GGPGRRPLPGLEVQMRSFFLWAPLIREAVSDSHWR

SEQ ID NO: 785364 - protein, 78 aa, Homo sapiens
SSSEGIISSVVSKSQAPLSPSPIFPAVVSPSHSFIHSFISYLQEAARRPTDTRQSRPCSSGGTWGDRESYLLGLISIT

SEQ ID NO: 785365 - protein, 133 aa, Homo sapiens
GRSWFSAGPGGGGAVGGAPDLSPIWGVARVRNWLEDGVCVRIWERGKRCRKHAGRFILQLWEWWTRAAALREARGRGGPPQGWSRLWSCQLPLSKAQGRHSLSPGRAWVWGPETRSPVGAVECTSSRRSKPAP

SEQ ID NO: 785366 - protein, 133 aa, Homo sapiens; identical to SEQ ID NO: 785365

SEQ ID NO: 785367 - protein, 258 aa, Homo sapiens
GETCSRRLSAERPWRCFSESGVAWQPAEDEGSAGAAPVVVAAMLGAWAVEGTAVALLRLLLLLLPPAIRGPGLGVAGVAGCGGGRAARERHLGGQRGWRGACGRALGSTSARTLWKAGWCRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFHRETSTIEFVKGYYDNPKVCALYIMAGT

SEQ ID NO: 785368 - protein, 65 aa, Homo sapiens
MPKRKAEGDAKGDKAKVKDEPQRRSARLSAKPAPPKPEPTPKRPCKEGVEKVPKGKKGKADGRIN

SEQ ID NO: 785369 - protein, 156 aa, Homo sapiens
VHAQCLELKAKGLSLGFLEKKHDEASSLSHPDLTSVIHLTRSVQLWPAMEYLAMLWRYKVTADFMAQACLRRCSKNQQPQINEEISHLISFCLYHTPVTPQELRDLWSLLHHQKVKITIRHKPPLHYELVRFSLTDWLGNILFILKIPYWKPQVFL

SEQ ID NO: 785370 - protein, 116 aa, Homo sapiens
TQTSTFPWVARSNSFILGEPSAWRPSLKLDRIPLSGGGGGSIHPGRASTPRMFSVQSRLFPSTDTPSSLFWSLAKSTSCCDSTPPRGKGWMPESQGSGSKRRKGWGCRPQLRGYQE

SEQ ID NO: 785371 - protein, 251 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKAQFELGKLMELHGEGSSSGKAAGDETGAKVE

SEQ ID NO: 785372 - protein, 479 aa, Homo sapiens
ISAWFGPPASTPAFTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMSRQLREYQELMNVKLVLDIEIATYRKLLEGEESRLESGMQNMSIHTKTTSGYAGGLSSAYGGLTSPSLSYGLGSSFGSGAGSSSFSRTSSSRAVVVK

SEQ ID NO: 785373 - protein, 55 aa, Homo sapiens
MSGRRGIALAVSYTSMGESGRGSAQGIEKRVPDLSFLFSKRMINGWQTQIVWSHF

SEQ ID NO: 785374 - protein, 78 aa, Homo sapiens
SGHTLQVLTLASLVVAPPDPPVSCSPSQGKGFIPEVPFMPLFSERMNLSWSDMAVIWIQFPVSLLQSPNCCLVVGRGF

SEQ ID NO: 785375 - protein, 109 aa, Homo sapiens [sequence omitted]

SEQ ID NO: 785376 - protein, 240 aa, Homo sapiens
GEGAGENWEPRVLPYHPAQPGQAAKKAVRTRYISTELGIRQRLLVAVLTSQTTLPTLAVAVNRTLGHRLELCGVPDGRTGACRAPPGMAVVTLGEELTHLDTCTWLLRHLLEQHGDDFDWFFLVPDTTYTEAHGWHCLTGHLSLASAAHLYLGRPQDFIGGEPTPVRTARRLWGACLSRMLLQQLLPPPGRLANDIVSARPDEWLGRCILDATGVGCTGDHEGVHYSHLELSPGEPVQKG

SEQ ID NO: 785377 - protein, 110 aa, Homo sapiens
MLCTSGRSTKIQLPKFGAWKIGFIGGRSLGCATTPQRGVYITRTPLGCIFGQRSLQGGLQKLPFSLDHPCSLVTCEGNWSVSTSALCLINMRSPSSGQRLSPPATQMEGK

SEQ ID NO: 785378 - protein, 110 aa, Homo sapiens; identical to SEQ ID NO: 785377

SEQ ID NO: 785379 - protein, 68 aa, Homo sapiens
SGQGVSHGVAEGCPQVKVAVMGWLKGVPMSVWAHSAPLGFLFECQGHERSSDDTMSGYLLQVGGKRPL

SEQ ID NO: 785380 - protein, 68 aa, Homo sapiens; identical to SEQ ID NO: 785379

SEQ ID NO: 785381 - protein, 32 aa, Homo sapiens
MQASVSRLLPLPSALYVLGDQTVTTSRVTGSS

SEQ ID NO: 785382 - protein, 183 aa, Homo sapiens
LAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 785383 - protein, 132 aa, Homo sapiens
HRAQAGPADLERAWVHPQDQQPRWQGQAGPPAPLAHSKEGGRPSSSRASRNDGPNGRSPPSLSPCPALLVAEEEKVVPESRTPTCPLHPQPLTPPSPVQGYKMDDLLTSYVQQLLSAMNKQRGSKAPALAST

SEQ ID NO: 785384 - protein, 130 aa, Homo sapiens; identical to SEQ ID NO: 742470

SEQ ID NO: 785385 - protein, 102 aa, Homo sapiens
MVYKHSKCRDRSSLRQLLSPKLLKTGTSTGCFHCIILIKAGDRASQSRFGTAAACAQEWEDCCLLQASYHLPLSSALVVSTHHPMDHDPPSCDLFLSWLLVS

SEQ ID NO: 785386 - protein, 231 aa, Homo sapiens
SGGGAVAVTAEKMAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQSLP

SEQ ID NO: 785387 - protein, 42 aa, Homo sapiens
DDYQVMDEFLYNLSSDDFNDKWIASNWPSKILGQIELVQQQH

SEQ ID NO: 785388 - protein, 204 aa, Homo sapiens
LPTKCMQLCQAGGYRAEALQAAGTPPSPNIAPRSRHVLSRALHTHVHSQAHIPTVTVSLGTLSACPWDLVLMLDRKTPGNPRPFRSPPRKVTSSTPLRGQRCSRSAGITGMSHRARPALRFLKSGSGMPLASFILFSVTSGQRCPRSVTHSNSRSRLYSMPRAGSKRRIAVEQSLLLYAQAELIAPIDLLQDSLQRITHVRPGN

SEQ ID NO: 785389 - protein, 147 aa, Homo sapiens
ISKPGRGDGRFCHSEVSQASEEHTEMQKPDERKMLEHNIQTTYEPQRGKGTPSAVGLPSLNPEIKFSVNQRECDGTNRHHEPRYGTASARTHDAFCRILAMKAKSEPNPEEIIRIIQYTLWDISKDSSGPGVVAHACNPSTLGGQGE

SEQ ID NO: 785390 - protein, 227 aa, Homo sapiens
KAGSPVNGQKQGHAHATPKIPLNLHLHHDPFRSLQEPRHQPPTMGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDG

SEQ ID NO: 785391 - protein, 254 aa, Homo sapiens
KAGSPVNGQKQGHAHATPKIPLNLHLHHDPFRSLQEPRHQPPTMGSKERFHWQSHNVKQSGVDDMVLLPQITEDAIAANLRKRFMDDYIFTYIGSVLISVNPFKQMPYFTDREIDLYQGAVRLGLGGRHSPQILAPSPGLRPDLPCQAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDG

SEQ ID NO: 785392 - protein, 178 aa, Homo sapiens
KAGSPVNGQKQGHAHATPKIPLNLHLHHDPFRSLQEPRHQPPTMGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIIRYGQSWGATDPAARAPAETSPPPGRFA

SEQ ID NO: 785393 - protein, 57 aa, Homo sapiens
SLEDLVPECSEASCGHPRVPMLSGRCAGCVRVNQILFADGSVWSFLEILLCPEREIL

SEQ ID NO: 785394 - protein, 141 aa, Homo sapiens
LLQLRCCAVGKGEGFVNPGVRFCLPEAAAVRRPPGEATVIMSDQEAKPSTEDLGDKKEGEYIKLKVIGQDSSEIHFKVKMTTHLKKLKESYCQRQGVPMNSFRFLFEGQRIADNHTPKELGMEEEDVIEVYQEQMGGHSTV

SEQ ID NO: 785395 - protein, 131 aa, Homo sapiens
MLRNAQTALHEAACSTTLLTLLDPGHCDLPIFPLHPGLRWRGAVYSCSTGMGGGSCGREGEKDTGTAPVQGRLPLTLQLAVGWLPRTRLSGSNPAFALVTFNKFLNLSDLFLQGRSSYNLCDRLRLNESLI

SEQ ID NO: 785396 - protein, 151 aa, Homo sapiens
LQMGLGFRPGHRIQPSRQCQAGGTSDYGEKSRYELWDQAPRAPRGADHPPTLGIGTRRPAGTQAHKHTCAHTHHTEVFISMQCAPVWGPTTHTHTHTRHHPGPQPAHTYSLLWGHTPSHTRPGRQALSPGHAAGTSGLPGRPPPSQTRLVT

SEQ ID NO: 785397 - protein, 263 aa, Homo sapiens
VGPGRLLRLGEALRSRPDPSGGCRLQPALVGETEMSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQAIGFSGWGACGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 785398 - protein, 247 aa, Homo sapiens
VGPGRLLRLGEALRSRPDPSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQAIGFSGWGACGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 785399 - protein, 229 aa, Homo sapiens
VGPGRLLRLGEALRSRPDPSGGCRLQPALVGETEMSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 785400 - protein, 263 aa, Homo sapiens; identical to SEQ ID NO: 785397

SEQ ID NO: 785401 - protein, 99 aa, Homo sapiens
NKCYCCKQKVSGLAPPLRAVTLTVRYVASLLKSASPRTHLERRATLDAPPLRAVTLVRVLTFGPPEREISVCLPEVWWQNCVEAAGASVRQWGSQHFLG

SEQ ID NO: 785402 - protein, 120 aa, Homo sapiens
MESIGQKLLHLIAAKRKENTYTDSVILSFFYSVEVDNRSLLLTKRSVLVNIAMNPNSPPSVYLSFIIKSTFFPTSHCLLASALSTPLHSQAPQKSCLLSDLLLLKPLITSLLPNPMDALF

SEQ ID NO: 785403 - protein, 89 aa, Homo sapiens
ALASGQHNAGRIRKARASVDDPLGRSWEKSLFPRADASLRVSFEPQKAQTLTRSFLPPRPCRTPPFLGGEAREASGEARPPGAKSSSER

SEQ ID NO: 785404 - protein, 356 aa, Homo sapiens
MEKTRNRKTTEEKKKTLGAAGKLMPGCVLGEKKKKKKNEKGEKESERAKKKGKQCKYKKEGKERKAKKKIKKEKPKQEEVFVNRKEYFEQAKGREEYDWIDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDSSISRGATQSMGSRGLEWVVERERRDRCRRGHLRMRWMSGNAASDKNIKDGVCAQIETELCQCQVEEGCPSDYTLMKRLRAPEQSSTAAAQSASATDTCTPGAADRSATQPQMEV

SEQ ID NO: 785405 - protein, 127 aa, Homo sapiens
MEGTRANLTGWDPQKGLIVRVCVSSAVGCGPWSQPLVVSSHDHAGQKGPPHSRTSWVPVVLGVLTALVTAAALALILLQKRPKETWFGQGFDSVISRGEPAIHFWAARSFNQERPKCIEATLESLGI

SEQ ID NO: 785406 - protein, 80 aa, Homo sapiens
RSLQLPPPQGSLWLHEAPLEKAQKGREVSRPLDCNLKRGHHCPLAPLPPSRTPGPTSGPGPTRSKTKTPPSEAPRNARCR

SEQ ID NO: 785407 - protein, 104 aa, Homo sapiens
MTSAHRLWRVFQIYHILRFCDSQKAGHEKIPSSVYIYGSEKTRGILASKTDIHHKIMVKYSLKQVQSEKRKESQKWGWSFNCIKPEDYLPPNFQEANKVPDCLN

SEQ ID NO: 785408 - protein, 101 aa, Homo sapiens
ASIILIPKPGRDTTHTHTHIHTNPENRQKTRMPSLTTRIQHSVGSSGQGNQARERNKGYSSRKRGSQIVCVADDMIVYLENPIISAQNLLMLISNFSKVSG

SEQ ID NO: 785409 - protein, 236 aa, Homo sapiens
EVGLGDEGLYTCSFQTRHQPYTTQVYLIVHVPARIVNISSPVTVNEGGNVNLLCLAVGRPEPTVTWRQLRDGFTSEGEILEISDIQRGQAGEYECVTHNGVNSAPDSRRVLVTVNYPPTITDVTSARTALGRAALLRCEAMAVPPADFQWYKDDRLLSSGTAEGLKVQTERTRSMLLFANVSARHYGNYTCRAANRLGASSASMRLLRPGSLENSAPRPPGLLALLSALGWLWWRM

SEQ ID NO: 785410 - protein, 97 aa, Homo sapiens
GTEGLLQEARDTPDQEGSTYEQIPACWGGPARAPHPGASPTYSPWVHGYKRISGTPELSEPGNTYEQIPATKSKETGRTHKPDKLRRLFFTYRKHKF

SEQ ID NO: 785411 - protein, 154 aa, Homo sapiens
MGNACWELYCLEHGIQPDGQMPSDKTIGGGDDSFTTFFCETGAGKHVPRAVSVDLEPTVIDEIRNGPYRKVFHPEQVITGKEVLAKNMPWSYYPGKGSWPMLGRGPAAVVPVAGVRGPGVHDVGGPAVVPNPEKGALETEETTGEYINTTPEVL

SEQ ID NO: 785412 - protein, 73 aa, Homo sapiens
TLDFRTLDFRTLDFRTLDFHSDCETASQFKRVRSKPGVPVSTDVVSTGLNSYTCMHNTLSKLFYNFTLEKLAL

SEQ ID NO: 785413 - protein, 68 aa, Homo sapiens
VATVSRKEERGGKVNFPPPTQIFLAGVVFTLPSQEGGVGRSTPIQGSLPRRKEDSQPSRGAWAGPMQA

SEQ ID NO: 785414 - protein, 1115 aa, Homo sapiens
PVHAVVIPVSHLSGFHLIPVWELNSVGKRRKEQLLLLQQRWMERSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGGDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKARDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAGEQRWECPLRNAVMSISHLSPRAWQIQSLSQNLKPSQVQWEIPPVQTLCETPELEACKPASFIPNAQMGQVTSLLCLPPPFLLAGLLSLQCLSHPCNPDSTCSSSTNSIPGYLIPSSLKGRVNATMI

SEQ ID NO: 785415 - protein, 1501 aa, Homo sapiens
LFSLLQVRGKGMPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGGDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKARDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAACPPHILPPEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 785416 - protein, 1501 aa, Homo sapiens; identical to SEQ ID NO: 785415

SEQ ID NO: 785417 - protein, 537 aa, Homo sapiens
LDAWVDPRVRIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAACPPHILPPEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 785418 - protein, 1501 aa, Homo sapiens; identical to SEQ ID NO: 785415

SEQ ID NO: 785419 - protein, 1501 aa, Homo sapiens; identical to SEQ ID NO: 785415

SEQ ID NO: 785420 - protein, 1501 aa, Homo sapiens; identical to SEQ ID NO: 785415

SEQ ID NO: 785421 - protein, 1501 aa, Homo sapiens; identical to SEQ ID NO: 785415

SEQ ID NO: 785422 - protein, 1501 aa, Homo sapiens; identical to SEQ ID NO: 785415

SEQ ID NO: 785423 - protein, 1252 aa, Homo sapiens
LFSLLQVRGKGMPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGGDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKARDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLELEASGVGQASGVG

SEQ ID NO: 785424 - protein, 67 aa, Homo sapiens
WYHILEATPPTQHGGSNKTQQQGRSQFAQWALESDAVWSSAPQKSLPGGGPLDSAKGPDGHRELYVI

SEQ ID NO: 785425 - protein, 228 aa, Homo sapiens
MYSQPASEECTIISLMTGNWGPRNLIWGLRMRGAGGQLFWGQPLASYSSRSSSRIELRKQTLKAELLTTKLEASRPPLDLCPGRPAQTPVPTHPLPSRCTDASGQNRTLLFSAPVSLVEFCAVASIPSHSGVSYAHCLPIFTQGCEELVTAETLDGTDQSRHSWEENLRGKPGPRQTELAIRQVRSSQSVTAASLQKESAIRKVVDFFLQVPPLLLWSRGNAAVSFHR

SEQ ID NO: 785426 - protein, 155 aa, Homo sapiens [sequence omitted]

SEQ ID NO: 785427 - protein, 110 aa, Homo sapiens
ALNSVWKRLKQANISQNLSTILGVAIHMFVYITEAQNYTIIINNILWTLIIMLFSISKHLISIDNYLLNEWVHWSDQGVIQGRCPCLPTLNLQNGAGSTQQALSELAKNF

SEQ ID NO: 785428 - protein, 127 aa, Homo sapiens
MLPLSIKDDEYKPPKFNLFGKISGWFRSILSDKTSRNLFFFLCLNLSFAFVELLYGIWSNCLGLISDSFHMFFDSTAILAGLAASVISNWRDNDAFSYGYVRAEVLAGFVNGLFLIFTAFFIFSEGS

SEQ ID NO: 785429 - protein, 127 aa, Homo sapiens; identical to SEQ ID NO: 785428

SEQ ID NO: 785430 - protein, 102 aa, Homo sapiens
MDVCIQTATSSRMHTRVCAQMQRQPCVGTYVCVHMRIHTAHTYTCAYTYIPVHKRAHMYMQPGSHDTLGVTFGRSLLQARSSSEWRICLQPSSLPQLWGAEG

SEQ ID NO: 785431 - protein, 31 aa, Homo sapiens
MGLWLTTPSTKKCGRKPTAFAEMSTVTFLFK

SEQ ID NO: 785432 - protein, 180 aa, Homo sapiens
GWKKERVVAEFWDGKIVLVLPHDPSFAIKKVEDVQELVDNELGFQQVVPKCPNKIKTFLFISDEKRVVGCLIAEPIKQAFRVLSEPIGPESPSSTECPRAWQCSDVPEPAVCGISRIWVFRLKRRKRIARRLVDTLRNCFMFGCFLSTDEIAFSDPTPDGKLFATKYCNTPNFLVYNFNS

SEQ ID NO: 785433 - protein, 180 aa, Homo sapiens; identical to SEQ ID NO: 785432

SEQ ID NO: 785434 - protein, 219 aa, Homo sapiens
SCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPL

SEQ ID NO: 785435 - protein, 73 aa, Homo sapiens
IIIIIIIIYNVISHRAQLRSDGFIMFDSCSFTCSHSLCGHHGSRTCPSAMIVSFLKDFPLCHDSKFPEASPAM

SEQ ID NO: 785436 - protein, 110 aa, Homo sapiens
AINDLYRHKTGLNGSYDLDILGPYRDGREGAKLPRCVLIIECQRDYVGQMWNNGYMPSTRCTLHTCHTCAIKPWSPTGQYPQSRFHSKTDLGDPAQVQKCPQRCFYLLRC

SEQ ID NO: 785437 - protein, 118 aa, Homo sapiens
ACGLREGGQLLSSRSRSWLVEEICFGHVRSEIPDFPVEESGVQGRRLEAGTRSHQMGPAEDTGRRADRERFKGTAPLRGQGVKVEPAEMSKRSEKQGPGAAAPACNPSTLGGRGRWIT

SEQ ID NO: 785438 - protein, 263 aa, Homo sapiens
SGRKVSREPCQLGHPEGRCWGSGRGRPGGLRRAPPALRLFRSVSLASRSCDAAFLFSCSRARTSAMGAPPCHVGRLLQHPGGPGPVWAGGCGDPCGAATPGTMSRNPGSCCVAELVLNSWPPASVSQSAGITGNVTSLDEYKDLQMSSCRGLQGSQKDHRGPGATCKRRSLWTPRASPSKAGSQPCALKPLKGLEVPIGKEARDCHGIRGPQGGSQESLPAWAKGTAYGKAAGTRPSSRRCAQRRSGGTGSRDRADTRLLFVC

SEQ ID NO: 785439 - protein, 106 aa, Homo sapiens
PGQERGLRWAFTSPPAGGETGPVPEGTRGRGAHAQSGKPKAWRGFREQGLEFLCQAGGWHQTPGRGRRRGPSKDSPQPLCLRLLRLLCADRVLCCVGNAASLLGTW

SEQ ID NO: 785440 - protein, 202 aa, Homo sapiens
TRVSTNQCSGYGSGEGGNAIKDHSSSSREPWESVSRLTPDTGSESKVGKEGQTNLDPSSCKSSHEKRHARVLSVDSGTDVFLSKSSAEIVNDTEKTMPTSKSDLEAKEGQMPNESNFLEFVSLLESINTSKMTASSQLNGSAEQNEESGLLRDNCSQEKKEEILENEKPSGHSSKQGKPDLQSQDHTSTGPACTQPAKTTAL

SEQ ID NO: 785441 - protein, 764 aa, Homo sapiens
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKTESCPVTQAGVQWRDLSSLQPLPSNFQRFSCLSLMGSWDYRCTPTHLANFVFLLEMGFHHVGQAGLELLTSGDLPASASQSAGITDMSHCAQLTKENLTVYLGDLLHKLQFVLTYVAPWQMAWGSSFHVFAQLFAIPHSAMLFFQTIATSIFSTPLSPFLGSVIFITSYVRPVKFWEKNYKCFWAT

SEQ ID NO: 785442 - protein, 663 aa, Homo sapiens
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYKCFWAT

SEQ ID NO: 785443 - protein, 658 aa, Homo sapiens
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYK

SEQ ID NO: 785444 - protein, 531 aa, Homo sapiens
AGALATQFPMLIVNFVCSFSVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKTESCPVTQAGVQWRDLSSLQPLPSNFQRFSCLSLMGSWDYRCTPTHLANFVFLLEMGFHHVGQAGLELLTSGDLPASASQSAGITDMSHCAQLTKENLTVYLGDLLHKLQFVLTYVAPWQMAWGSSFHVFAQLFAIPHSAMLFFQTIATSIFSTPLSPFLGSVIFITSYVRPVKFWEKNYKCFWAT

SEQ ID NO: 785445 - protein, 780 aa, Homo sapiens
TRVSTNQCSGYGSGEGGNAIKDHSSSSREPWESVSRLTPDTGSESKVGKEGQTNLDPSSCKSSHEKRHARVLSVDSGTDVFLSKSSAEIVNDTEKTMPTSKSDLEAKEGQMPNESNFLEFVSLLESINTSKMTASSQLNGSAEQNEESGLLRDNCSQEKKEEILENEKPSGHSSKQGKPDLQSQDHTSTGPACTQPAKTTAFFQGNRQRQIIYRVTSQQDSSVLQVISGPETSVQEEISVDAMHVFIDEHGEIRSCYLKSGNQKEGPLQPLPSNNDCLSQAREMQVSSSSTTTSESQDPSSGDPAVSALQQQLLLMVARRTQSETPRNEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKVFLGYVRQK

SEQ ID NO: 785446 - protein, 472 aa, Homo sapiens
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRG

SEQ ID NO: 785447 - protein, 590 aa, Homo sapiens
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKASELAIFFILTF

SEQ ID NO: 785448 - protein, 641 aa, Homo sapiens
MHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPRILSASIFTLQLRFTFYGSKLFIDPWQ

SEQ ID NO: 785449 - protein, 262 aa, Homo sapiens
EGAVGRCAPAGHFPGTPLVFLGPRFSTAPLRVPGFQTPSHDMEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQG

SEQ ID NO: 785450 - protein, 222 aa, Homo sapiens
MCRTAAGYRRGDANRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQG

SEQ ID NO: 785451 - protein, 278 aa, Homo sapiens
SLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARQRLVAQPQGPTRGWGRCR

SEQ ID NO: 785452 - protein, 72 aa, Homo sapiens
KAISPEPSSLLVHRATLKEQLIAPVAEEEATVPNNKITVVGVGQVGMACAISILGKSLADELALVDVLEGSF

SEQ ID NO: 785453 - protein, 287 aa, Homo sapiens
MPALCLVLCWFQGLLGEVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 785454 - protein, 144 aa, Homo sapiens
AGAAAGFQSSFGLGREEVSMLGPRRGAHAGQGRDRLRGEQLRGPWPWWNLVRPAGLIGEGAFSFSDACRLPYLCQGLPSPSGPLCVCFLSHKGSSEPSRLLPSPQPPPRPGVFQLPAGLPALQAQAVLPGLSTGGLGCWPGGSL

SEQ ID NO: 785455 - protein, 33 aa, Homo sapiens
MGCTYSSPPEEPALRRSVPDTVPGGRLPSCPLA

SEQ ID NO: 785456 - protein, 179 aa, Homo sapiens
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSFHTGEKPYECKQCGKAFSRD

SEQ ID NO: 785457 - protein, 69 aa, Homo sapiens
LQPQLESRALRLGSSWAQASAQSFLAGPSAPLLQGLETSSMGLRIISVCGRHMVNLSKRKKWYQYKSKI

SEQ ID NO: 785458 - protein, 63 aa, Homo sapiens
HTPRAHTPLVTKSRCDEVVAAHCQNAHTRYLGIQSFRTAQERPSKIQKFTTRVLTRKKFTPGG

SEQ ID NO: 785459 - protein, 170 aa, Homo sapiens
MTLLAQEWGAASHLLLWGRVSPGSGPRWRICSMSCDVLQPRVTESLLWATKSTQPLAMGHPAGPLDTETCGSQPVVILCPGNTWPSLGSILFVTVYGWGVTRHPTVHRTAPQQTSPTVSSTEPGKPGLEPFLSRVPAREPLTAMENPSPPVSQDSPRVKDGCLPIEGQTN

SEQ ID NO: 785460 - protein, 47 aa, Homo sapiens
MHFGAGVVPASKQTAALGALKEEVGDCHSCCEGARSRLWAQGWGLAA

SEQ ID NO: 785461 - protein, 125 aa, Homo sapiens
MTHRLCSGRCWNLALYTQGWFPSHLPGLHRTMPPPLSKPTLPLTLLEDGLGVGGVNTAKQLTGIAQRKGGERDTLGNAAALGEMDELSHFTGATELTVNIRSNDIDFKVLWFQMSLVLSFSFSLL

SEQ ID NO: 785462 - protein, 53 aa, Homo sapiens
MAKVIFLKYKPPLNCSTVLQCFWNDAPKPSMDLAPDPAFLFSIHIHIFLQLCQ

SEQ ID NO: 785463 - protein, 193 aa, Homo sapiens
EKSFGEELLTLPPGTACPGAGWRQGRAGQSQVLPGKSPWAGAGGLELLAVTVCLSRRVSTVYWYHGPRSRRGMEIRTVPLGPPVCTGGALRQLLKPLSHYTDGADGDTEVQRDSQLSSELDPEPRLLAWPPSAAPHVASEFPVWDWGSSGPWGTTMLFWSCQLGRNPLVPTLCLCGPLLASAVPLGGPTTLFF

SEQ ID NO: 785464 - protein, 56 aa, Homo sapiens
EDLSDSGPPQTPTPTSGPAGSQGARPTHQAANPPPNGHVAWDCTEVVTNSTWSERT

SEQ ID NO: 785465 - protein, 89 aa, Homo sapiens
GCLEDPRDKQDTSDNVERSFKHTVRENSEEAEPEKYYNSKNTTCKGKSTYFEDKMSTALGKTGLEMEKLLLSKLGFALRLGNINRETKY

SEQ ID NO: 785466 - protein, 162 aa, Homo sapiens
MPHFLDWFVPVYLVISVLILVGFGACIYYFEPGLQEAHKWRMQRPLVDRDLRKTLMVRDNLAFGGPEVLSRLAKGIGGRHRAAVRASQHGPHNPYHAKYQRPNSPSTLTSNHYGPRGNSTSERWGANASVREEGRMSTHQSSQERAPQHADDRDTTEAITEA

SEQ ID NO: 785467 - protein, 162 aa, Homo sapiens; identical to SEQ ID NO: 785466

SEQ ID NO: 785468 - protein, 88 aa, Homo sapiens
LSGERWNRVRGQGQWGETGTEGEVRVRGGETGTEGEVKVSGGETGTEGEVRVRGGETGTEGEVKVSEERREPRERSRSVTRDGNRARA

SEQ ID NO: 785469 - protein, 230 aa, Homo sapiens
PYPCPECGEAFSLSSHLLSHRRAHAAASGAGAAALRPFACGECGKGFVRRSHLANHQRIHTGEKPHGCGECGKRFSWRSDLVKHQRVHTGEKPYMCSECGETFSVSSHLFTHKRTHSGERPYVCRECGKGFGRNSHLVNHLRVHTGEKPFRCGQCEKRFSDFSTLTQHQRTHTGEKPYTCIECGKSFIQSSHLIRHRRIHTGNKPHKCAGCGKGFRYKTHLAQHQKLHLC

SEQ ID NO: 785470 - protein, 109 aa, Homo sapiens
HLIPICDLSTTQLKLLFQVTDNLQTRLNPNETLLSSRTPHSQQHARQSPRRRSSLEHSPRLASLMSHTRCFLTGHFSVSLVGGLLLSFLPSFFCPTDNTEAPTEVRLWT

SEQ ID NO: 785471 - protein, 209 aa, Homo sapiens
EIIGFVIPGLQWFIGKSTSSGQVGFVPTRNIDPDSYSPMSRNSAFLSDEERCSLLALGSDKQTECSSFLHTLARTDITSVYRLSGFESIQNPPNDLSASQPEGFKEVRPGRAWEEHQAVGSRQSSSSEDSSLEEELLSATSDSYRLPEPDDLDDPELLMDLSTGQEEEAENFAPILAFLDHEGYADHFKSLYDFSFSFLTSSFYSFSEE

SEQ ID NO: 785472 - protein, 269 aa, Homo sapiens
MKPARLFIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKDQDQLHNALNLNRHDLTSIMLGKIHLLEGDWTKAIDSLLRKQWSSQPENTGASYNLGIIYLQLGIYQKAFELLGSALTYDPTKYKAILAAGSMMQTHGDFDVALTKYRVVAVLFQKVLHSGITLECVSLAEEICGGISCLKRATTWHLRLEDLYNLGLSFDMQ

SEQ ID NO: 785473 - protein, 295 aa, Homo sapiens
MPRPGHPRPASGPPRLGPWERPTELCLETYDKPPQPPPSRRTRRPDPKDPGHHGPESITFISGSAEPALESPTCCLLWRPWVWEWCRAAFCFRRCRDCLQRCGACVRGCSPCLSTEDSTEGTAEANWAKEHNGVPPSPDRAPPSRRDGQRLKSTMGSSFSYPDVKLKGIPVYPYPRATSPAPDADSCCKEPLADPPPMRHSLPSTFASSPRGSEEYYSFHESDLDLPEMGSGSMSSREIDVLIFKKLTELFSVHQIDELAKCTSDTVFLEKTSKISDLISSITQDYHLDEQDAEG

SEQ ID NO: 785474 - protein, 195 aa, Homo sapiens
MSNSRPRSRRDAGGGAGAAGRDELVSRSLQSAEHCLGVQDFGTAYAHYLLVLSLAPELKHDVKETFQYTLFRWAEELDALSRIQDLLGCYEQALELFPDDEVICNSMGEHLFRMGFRDEAAGYFHKAVKLNPDFSDAKENFYRVANWLVERWHFIMLNDTKRNTIYNAAIQKAVCLGSKSVLDIGAGTGILSMFC

SEQ ID NO: 785475 - protein, 105 aa, Homo sapiens [sequence omitted]

SEQ ID NO: 785476 - protein, 90 aa, Homo sapiens
SCADNDGNGGNGDDDGVDDGDDNDGIGGNGGSLCWMPLPRKFDRLKQILAEESAHSGVGTLGPGGMGLRVGSSDHWVAQFRGKSTVFPAG

SEQ ID NO: 785477 - protein, 239 aa, Homo sapiens
RVGLLGPAPPAPSSLRPGQDGRWPQQGWPEMEERGPDPGYGETLDVAVDPLTGLWDVIISWGLTVAQEHQDPALPSASHGASPLQEAIQGLHGRGAAPQGGGAWQPARRSSLQPRPQAQCAPQQPCQSPCDTAAGMPGHAAQLGWGRGAGPGAAESAAPGRPRLGKDAGAAGRSLFWEPSGGAPGGGVGGVSGLRPLQPAAWEVRLTGAGCRAAPASEGMSGGLQGGPGQRGALSKGDP

SEQ ID NO: 785478 - protein, 66 aa, Homo sapiens
SNSVQLRDPGWWEALLHVFSQTPIFSGSYSHTCSTYGLYTWFHGNYKDVIFQATLRRRGSAGKSDL

SEQ ID NO: 785479 - protein, 104 aa, Homo sapiens
MLQPSHDPSTFRENGPSCRVKWFRRTLSPHGGLGGFCPRPQRRGDPEFSVSPPQPLPLKLLSPRLWGGTREGLARLLCDPRCSCLAELSPCGLRAAGPSRVSEH

SEQ ID NO: 785480 - protein, 292 aa, Homo sapiens
VVVPRSPTRTPSPGPRPPTWDPFSRASSPDTRPGTPSPGPRPPTRDPFSRASTLDPRPGTPSPGPLPPTRDPFSRASTPDHRPGPFPGPRPPTRDPLPRASTLDPGPLPPGLDPRPPIRDPFPGASIPKSQPGMPSPGPRPLTPNLDPGPRLPTQDPLPRAWTPDHRPRTLSPAPGTPQRQAPFPASSVGGTVRCLFGLSGLGMSGQRAPEKVTVAPPAPNSITANQKDSDRKRSLSARPWSQQLFASILHVGKQRYPVPVEGMYRMAVHPSPVLVRTDSISHAHSEPQKQS

SEQ ID NO: 785481 - protein, 111 aa, Homo sapiens
TAFGDHLATSSEERSLRRFWLQEEGSQRMPGTRGGPQGGQRGSQRGFGVCRENLGVGKTGQLFIPSGLHFGCCLRGGSRACWLGLCFGAHLTFNSVTLNKLITWTSWVQYL

SEQ ID NO: 785482 - protein, 112 aa, Homo sapiens
MKKSLPTRLAPSLTSYPLPREPEAAAVASMDSTKPKPPLFSTAGRTKLRPGPKLWDVLATYFQPHSTQQAWRAGTGPSRTENLLEQIPGNSVSLLFRGLLFFSEALQIDYRK

SEQ ID NO: 785483 - protein, 216 aa, Homo sapiens
LGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVG

SEQ ID NO: 785484 - protein, 66 aa, Homo sapiens
MGRAMLRLWVPGQVITFLSLGSSFRKMGPYPRLSGAVGEDDRLLHSKGEADKALQSPAPCSGLRAE

SEQ ID NO: 785485 - protein, 44 aa, Homo sapiens
MVKTVLEDEIPAAIYARDKSGVRIGVRKTSWRLQPEALPGFLYR

SEQ ID NO: 785486 - protein, 39 aa, Homo sapiens
SSHKQTRRPQVPPGPCREATTVSGSSEGTAPALRGKKLA

SEQ ID NO: 785487 - protein, 125 aa, Homo sapiens
MLADHSDKGNKLHNSLNEVVRENFTDFTRTGATSLLKCITVSTAEVFRNLLHCLECEQHGRDKLWGSHCIVKPPPSLQGQVSKGKERGLGVPQGPAKDRSRLERSTGPLWPQGWGRPQTLVTSGT

SEQ ID NO: 785488 - protein, 137 aa, Homo sapiens
MGVRLMVDAEQTYFQPAISRLTLEMQRKFNVEKLLIFNTYQCYLKDAYDNVTLDMELAHREGWCFGAKPVRGAYLAQERACAAEIGYEDPINPMYEATNTMYHRCLDYVLEELKHNAKAKVMVASHNEDTVRFALRR

SEQ ID NO: 785489 - protein, 135 aa, Homo sapiens
TQKTSQSICLGTWPVFWITACLGELGIPQLGGREPLFAFLRQGFPLSPRLERSHAVTPHCSLSFPGSSGPPTSASRVAGTAGARRCLWLIFKQFFEMGSRFVAQVGLELLASSVPHVSASHSVGITCMSHCRQSD

SEQ ID NO: 785490 - protein, 105 aa, Homo sapiens
NKTGILKKKSEIVILSLYLFGMAKMCYWSLRVRFHFPNLFLKAFNRSHFLFHSSSHTSKNDLCNIYNMQAVECWLLKMGSIFKYNIFLNHAQKNSPTGTLFHTVY

SEQ ID NO: 785491 - protein, 100 aa, Homo sapiens
CALRPREPGCRAGETSAATGAVAFGSRFRADTRAGLRQVSALPAMGCSSSALNKAGDSSRFPSGETGEKVETDMENEKVSEGAETKEEETGEVVDLSAAT

SEQ ID NO: 785492 - protein, 418 aa, Homo sapiens
CALRPREPGCRAGETSAATGAVAFGSRFRADTRAGLRQVSALPAMGCSSSALNKAGDSSRFPSVTSNEHFSTAEESESCFAQPKPHALGRESTVDGNVQRESRPPLQKLKVSAEPTANGVKPLQEQPLAKDVAPGRDATDQSGSTEKTQPGEGLEESGPPQPGGKEDAPAAEGKKKDAGAGTEAESLKGNAEAQPLGPEAKGQPLQAAVEKDSLRAVEVTENPQTAAEMKPLGTTENVLTLQIAGELQPQGTVGKDEQAPLLETISKENESPEILEGSQFVETAEEQQLQATLGKEEQPQLLERIPKENVTPEVLDRSQLVEKPVMNDPFHKTPEGPGNMEQIQPEGIVGSMEHPARNVEAGAYVEMIRNIHTNEEDQRIEGETGEKVETDMENEKVSEGAETKEEETGEVVDLSAAT

SEQ ID NO: 785493 - protein, 111 aa, Homo sapiens
TVLRQKQFAACSFKGQKNCILADIICLKFLISYFSYGLSFCIGREDAPFIYGSLFLLQLHFHKLMSVLLRKSSALFFTLSTLLRNSIYDTITQSLHLNSTTIHKIVGIHKP

SEQ ID NO: 785494 - protein, 42 aa, Homo sapiens
MNMWLLLIGLTTLMWNTLGYTVLYIYSPFTILKKQYAYLLNL

SEQ ID NO: 785495 - protein, 61 aa, Homo sapiens
MSQPVSLIPDELVWRAEMNDFFFNCNFLLTNQSAIGALTVNRLLSYSTWVPRKRLGVLLSG

SEQ ID NO: 785496 - protein, 81 aa, Homo sapiens
PSLKPDLRRPGEQLCCPEQFFQNSAPQTLPQKILNRALDGGTLDREKWLKPSLSQIISVQMIQERIPTGNPCQIIENGRTT

SEQ ID NO: 785497 - protein, 153 aa, Homo sapiens
MAKVCRAMLRNPLHSAGSWEPRIACEQRRDTHCLQGLQLWQSLNNGVCEGKAQKTGTTGDQSVRMLPMRPHGCPYFYQAVPAHSLNNSLSQTTVHTFLLQLLSSLSNDDRFPFFYNTIKSNPRRTFMSSHLLISQPAAGDPLPSHLPQKGNCL

SEQ ID NO: 785498 - protein, 98 aa, Homo sapiens
SEHKRLLNVVRLVYAQKSCTVPLWQYLRKARGCSCTIGFTVTSAPGHENVHCNHPFLFFIRHNESNSILFFGRFSSPEDDRCHGIAAFNKKQLPVILL

SEQ ID NO: 785499 - protein, 96 aa, Homo sapiens
CLQSEPGRQASPCTIRTAIDTAASNSTWTITEFQAQSPTDLPPAPAAHANKSQGTRPHLEQVPGRREHYLPVGKMGKRTDVPIISIENETVQGQSC

SEQ ID NO: 785500 - protein, 133 aa, Homo sapiens
AKRKHPGRISCNSFPERGRGRPRSEVARRRWGPELRRNWVGAVPGGRPGAARSCPEPLNPLGKANADVNIPTPQGTFGPGLELKFQTEWDRAESSTRQRSMARGQALTPGFVSSGEAGTPARPARVRRGLLGF

SEQ ID NO: 785501 - protein, 122 aa, Homo sapiens
MEQELQPLTVSCICKGRKLMTQGGYDMVQKLFLDFFRGGEPEANCRGTEQRNILKPRNEQEEQEEKREIKRRLTRKLSQRPTVEELRERKILIRFSDYVEVADAQDYDRRQISRGPASPLQT

SEQ ID NO: 785502 - protein, 594 aa, Homo sapiens
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYVCGQCGKSFSQRATLIKHHRVHTGERPYECGECGKSFSQSSNLIEHCRIHTGERPYECDECGKAFGSKSTLVRHQRTHTGEKPYECGECGKLFRQSFSLVVHQRIHTTARPYECGQCGKSFSLKCGLIQHQLIHSGARPFECDECGKSFSQRTTLNKHHKVHTAERPYVCGECGKAFMFKSKLVRHQRTHTGERPFECSECGKFFRQSYTLVEHQKIHTGLRPYDCGQCGKSFIQKSSLIQHQVVHTGERPYECGKCGKSFTQHSGLILHRKSHTVERPRDSSKCGKPYSPRSNIV

SEQ ID NO: 785503 - protein, 420 aa, Homo sapiens
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYVCGQCGKSFSQRATLIKHHRVHTGERPYECGECGKSFSQSSNLIDIAEFTLEKGLMSVMNVEKPLGPNPLLFDTRELTQEKSHMSVVNVGNYSDKASALLYTREFTLQQGLMSVASVGNHLA

SEQ ID NO: 785504 - protein, 35 aa, Homo sapiens
YEGITSRAFVPPHQKHPQKFHEEENKILQETFRLY

SEQ ID NO: 785505 - protein, 71 aa, Homo sapiens
GPRGMQTSPVNHNTHSLAKFRQTFKSFSSQYSNLLPFKAWAFDQWHWHHLGAYNKCRITPVILALWEAETG

SEQ ID NO: 785506 - protein, 137 aa, Homo sapiens
RGTLPIDQDTGPGKRMFQSRGQDGCHFTCYGRFTNKSSLWHESFGKFCNKCISNFTSRHIHVCLSYFAASFSYFPVPLSFYDQFILFRLPVTLPLPPILWVSLERNHSPTQQGLISELCFRILLERLSALSSAIGRL

SEQ ID NO: 785507 - protein, 75 aa, Homo sapiens
CHPMNSLESYAFNMKATVEDEKLQGKINDEDKQKILDKCNEIINWLDKNQTAEKEEFEHQQKELSCCNWVTTAQR

SEQ ID NO: 785508 - protein, 254 aa, Homo sapiens
FPAPAPPPAPAFAPPPKVPSPERSAPRVPLPSPQPSYPFRPAASGGTPPPACLPPAQPCQGSPAMNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFVVFCLLDKKKKSFHSLVFDSDDSFFFYSVAPIFIKCF

SEQ ID NO: 785509 - protein, 141 aa, Homo sapiens
MKVVYIACSFTTVWLIYSKFKATYDGNHDTFRVEFLVVPTAILAFLVNHDFTPLEILWTFSIYLESVAILPQLFMVSKTGEAETITSHYLFALGVYRNALSLQLDLALPFRGLLRPHRHCGQAWSRQSSTAISSTSILPKS

SEQ ID NO: 785510 - protein, 267 aa, Homo sapiens
FPAPAPPPAPAFAPPPKVPSPERSAPRVPLPSPQPSYPFRPAASGGTPPPACLPPAQPCQGSPAMNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRNALSLQLDLALPFRGLLRPHRHCGQAWSRQSSTAISSTSILPKS

SEQ ID NO: 785511 - protein, 258 aa, Homo sapiens
MFSRTFRKHGVVPLVTYMRIYKKGDIVDIKGMGTVQKGMPHKCYHGKTGRVYSVTQHAVGIVVNKQGQILAKSINVHTEHMKHSKSRDSFLKCMRKMIRKKKQKKKKTIFGRLLGLEKVFKPHSLWGAGPQLGYGDTLGQRGPKEKPGHGHPGVGFPHQNKNRGGTRKLFVASTSPRAVSGGPKTGSPHTRVPREIEINAGRRGGKQHNPPPKQVERKNNTTEKARQQQHTENSTKARNKQRQRSNTHIAKRKNDDRQ

SEQ ID NO: 785512 - protein, 112 aa, Homo sapiens
MYTAGASLAIFLPCHLLALFYGALQITAAWNWFLPIPRFGCSVSPEVYSICFQLYPPFLLKLDRIGVFGQTLFKPFKKGLGVWVLWLMPIILAFWEAEVGRSLEARSLRPAW

SEQ ID NO: 785513 - protein, 94 aa, Homo sapiens
KNFCLSKDSGKIKKKASPHNEIPLHSYICWKKKKRITTNVGKDVRQLEAFCIAGGKMELRGCCGKTPLNATPGVTTGSSNSTPDYRPQRIENWC

SEQ ID NO: 785514 - protein, 62 aa, Homo sapiens
MRNTAAASKLIRRVRDSQLLRSADRSTTRGAARGAAAKGVWMIFLEQQFDSTVSILSMKHDC

SEQ ID NO: 785515 - protein, 108 aa, Homo sapiens
HTMFPALSSLLALSSLHCLFLLTWVRVCRSSSPSGSGLRHSKWSFLEREPRSKGTERGVAELRGNQESKISPCPQAIPARWPTGDANVLLPETMQAEEGMSQMETHTR

SEQ ID NO: 785516 - protein, 373 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 785517 - protein, 366 aa, Homo sapiens
YCIFNFYLEQRSLGLSAPGLTTLCHWEYSLSSSSHHQERQAESYRCLTLPRSIPQVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 785518 - protein, 385 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQTGVQIYLLTRTCGEKVGER

SEQ ID NO: 785519 - protein, 183 aa, Homo sapiens
GRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 785520 - protein, 74 aa, Homo sapiens
GLQGTYPCTRVRSYTTPSSLYLTPHDLSASAALNPDFHILHSVGPLCSTWTPAICAMVGSSSKTESWVIMGFTS

SEQ ID NO: 785521 - protein, 106 aa, Homo sapiens
PLHGFNSYLYAHAHTPQTFLLSSQPTLANIPGAPKTHYLPPKRERNWYHYSPVVQVTTFVPLKPICISPSALSLPQADHHHPCLEKSLTTALLDSPQFIHPSHCTQ

SEQ ID NO: 785522 - protein, 173 aa, Homo sapiens
CSVAQAGVRWRDLGSLQPPPPGFKRFSCLSLLSSWDNRCVPPCPANFCIFSTERVPPCWSGWSRTLDLMICPPRPPKVLGLQARATAPGHQPPILFKVTPLLTEIDAYLSCLLWKGSSETLKNVPFVYHPSVTWELRPLFEYSCLRFKLSRLYRWNQCTSYIYQLMPHVSLSV

SEQ ID NO: 785523 - protein, 31 aa, Homo sapiens
AIVAPAGCAGPRTLREARVRGHEFEANLVHM

SEQ ID NO: 785524 - protein, 56 aa, Homo sapiens
KVIHGIPYNRPADLQAQTQGQIEFTCSDSRWRFLIRTGTNPGSVEPKVYAILTALL

SEQ ID NO: 785525 - protein, 79 aa, Homo sapiens
AVSRDRGSTVQPQQQRETVESRRGRQKRGERGEEPQEIFEDIMLKNFPKFMKHHKPQIQESQIPSSRKIPRNTDLGNYY

SEQ ID NO: 785526 - protein, 87 aa, Homo sapiens
FCLHTHLRNPASRTPVTLQEDEEAKAGSSPTGNTELSGASKTAVSPIKEAQMETRDCPHPSPWHRLKRLITGGASQGVGNRPSGWQE

SEQ ID NO: 785527 - protein, 37 aa, Homo sapiens
MWIVFKATRLGCMLCVTKVKCLRCPHKPTVSAEPNNH

SEQ ID NO: 785528 - protein, 87 aa, Homo sapiens
ISDCCASNQRDSVGVGPSEPGAGYNLVVRRFLSPSEKRSIRVGVTRFSRCRPSPLSLTQKRNSLTPCASQVRQCLALLGLTHGAHTH

SEQ ID NO: 785529 - protein, 94 aa, Homo sapiens
LSLTLVWHGEETGEGQKQEALPASAQVFFQAHRAVGNSHGCHLISTQEDLIYCKTLLLLLPPSVRSNIRVTVTATAVIINLVVIILLDEVYGCI

SEQ ID NO: 785530 - protein, 242 aa, Homo sapiens
AELERWRRQLPPGLARGLDLGTPQNGPEGEAPERRAEVRTVMLNALLRASRKWEAAVTPLLVALTPCDPTDLELVAALLTLEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITA

SEQ ID NO: 785531 - protein, 68 aa, Homo sapiens
MAPLFIHTQQESGVNVMRGTKLVASLQTNAYIMNRHIKEKVVESVSTPKEKMHIIDPASNHNSEHKSL

SEQ ID NO: 785532 - protein, 96 aa, Homo sapiens
MSVGWSLAGLPKARAGVSDSADLWGAGASSLLISSQLMLMPLVQMPYSENPCAQVTGHLAACEFPVVSGLAQLVVADILSVNFNLESFREQSPVLT

SEQ ID NO: 785533 - protein, 64 aa, Homo sapiens
GPHALFFMRARISLHGRLRSATVPNLTCFLILTLPQSQRNCHIHHKNQTSPNDLSPGELKKRVL

SEQ ID NO: 785534 - protein, 308 aa, Homo sapiens
VLYAPRSRAASLQPASREGCAEGGGAERREVSPPPEPGETRASSVTARRPPCRRVGLETDPAPSGSPPCASDSQTWKVFNVTLNGSPKDALMDDSDTPTYYLQIEPQDGCHPGDSVERSVTCLPSASDENENQLDGDGHEHLTSSDSAMGKPQVSEQDSLNNNESCTLSCEVAAGENSQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGDVEQLDSKSTSPLPSSDSRILFQDEDYDESTDIHSGYE

SEQ ID NO: 785535 - protein, 77 aa, Homo sapiens
GDGHEHLTSSDSAMGKPQVSEQDSLNNNESCTLSCEVAAGENSQNTLCEASRDEQAFLGKDKKIPGKRSPRSNKRDC

SEQ ID NO: 785536 - protein, 275 aa, Homo sapiens
KQAGPPRVMGSVTARRPPCRRVGLETDPAPSGSPPCASDSQTWKVFNVTLNGSPKDALMDDSDTPTYYLQIEPQDGCHPGDSVERSVTCLPSASDENENQLDGDGHEHLTSSDSAMGKPQVSEQDSLNNNESCTLSCEVAAGENSQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGDVEQLDSKSTSPLPSSDSRILFQDEDYDESTDIHSGYE

SEQ ID NO: 785537 - protein, 40 aa, Homo sapiens
MPGGRVCLVLDEVEVGCLVDECVWCWMKLRLVLDEVEIGC

SEQ ID NO: 785538 - protein, 143 aa, Homo sapiens
PSQQLHPIPGTLIHQASISTPSNTRSDTLPLRAAKTSTKQRRDEKVERLVAPLKRVWSPDGLLSMDRSQWTKLLCTRRSPDRLVSLPFYQSLISQPGYQGRVCGVCSVGLCIVYNGLLCIVHVCRPMWYQIGIVGVCRAFGVC

SEQ ID NO: 785539 - protein, 129 aa, Homo sapiens
LCSDPPWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVGQNIRWIL

SEQ ID NO: 785540 - protein, 697 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 785541 - protein, 600 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSRTCYPPP

SEQ ID NO: 785542 - protein, 178 aa, Homo sapiens [sequence omitted]

SEQ ID NO: 785543 - protein, 697 aa, Homo sapiens; identical to SEQ ID NO: 785540

SEQ ID NO: 785544 - protein, 697 aa, Homo sapiens; identical to SEQ ID NO: 785540

SEQ ID NO: 785545 - protein, 677 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQAQPERKYFQGIFVGEM

SEQ ID NO: 785546 - protein, 176 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASALWEAKMGGSLEPRSLRPAWTT

SEQ ID NO: 785547 - protein, 300 aa, Homo sapiens
AAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRPLLREGARLRQRQVHPSEQVRAWWSRCTSGAPGFPHPGPGRLSSHGPRAASVCLSLAPLSPVRLPSS

SEQ ID NO: 785548 - protein, 286 aa, Homo sapiens
CDSRIEKEEMIPKQDISEELESQRAKSEDHVRNIFKETEEMSKTEGKLENCWRKYAVEGVKNSFSQKSNFREITMRYVKTLSRENGQKFNAVGENCITDSNPAKHLRGSREESLHPSVSSVENLQQHEDLINLQSFQLGERAYQTDVLVKVPRQSSVLSENQRMNNPERWFESTGRGKTYNQNRAFNQHQRFHSGEKTYEHNECGKAFSWPSILSKHQRIHTGKKLYTCEDCGKSFSVHSYFIQHCKIHTREKPYECIKCGKAFSTHSSYVQHLKIHTGEKHHECN

SEQ ID NO: 785549 - protein, 79 aa, Homo sapiens
GPGLTWLCGFWGLAEMRYTSRPCEDRRAGQCHSPEGGPGQLVESEDLAPSFISLFFSLRIFIIIVLISKPGYCPPTQKK

SEQ ID NO: 785550 - protein, 102 aa, Homo sapiens
VVVAFPGTSSLGPAELSPRGIESGAGQHSEAISSLFCCQISLFSSCTRGGNTKGIGHPETLIEFALPFHLCETLNGCLPSYNLFLHLQCSLTVCTSQRSCER

SEQ ID NO: 785551 - protein, 38 aa, Homo sapiens
MTIIEANNYNPENEEQGAWVKPTAAWAHRGVGNGSPAR

SEQ ID NO: 785552 - protein, 346 aa, Homo sapiens
LVGRGESAEAWLQRIGTPGGRELGLHVPPTDPGVMAFPLLAGTLPHVESHTTSCEPGSPGGPPDSSQARHRQSLFPRLRISKAWGPAHPPLLSRPACPQVSAGRGHLPQPRKTRTPRVQEEAGAGPLGCHSLSPCPGPLPLVLEYALVGGPCSAQPGGSQCHQNQGHGNSIDGFCSPGPPMRGQCVGGAGPPMPMRGQCVWGAGPPMRGQCVGGAGPPRVQGTLVHCPTRHLSQRRGPGRQRGNSLPEPSSMLTCPQKTKSNSCDCLRLSRQASSQDELPLTELEWFRGQCQAGLWRKGRSEVAKPNRVLPVAGRNPRCPGLFAPGFRRKLVQRLASSLTPGRRLG

SEQ ID NO: 785553 - protein, 351 aa, Homo sapiens [sequence omitted]

SEQ ID NO: 785554 - protein, 351 aa, Homo sapiens [sequence omitted]

SEQ ID NO: 785555 - protein, 351 aa, Homo sapiens [sequence omitted]

SEQ ID NO: 785556 - protein, 115 aa, Homo sapiens
MSQDVEMCPWGQKCPQLRICPRGTHPHQASGFCVDQVPRKRNISAGRGGSRLESQHLRPGVPEQPGQRSERPHLYKKKKERKKMRDPGLKIHKHHKETIHYETQQKQQIDSRPRY

SEQ ID NO: 785557 - protein, 179 aa, Homo sapiens [sequence omitted]

SEQ ID NO: 785558 - protein, 351 aa, Homo sapiens [sequence omitted]

SEQ ID NO: 785559 - protein, 351 aa, Homo sapiens [sequence omitted]

SEQ ID NO: 785560 - protein, 138 aa, Homo sapiens
HEASCRFGTRQPHRATFPAAPGLQGCPRTGPSQPSMQLPSYPEDGSGLSRGHKDVRPGPPGQERVQVLRACAPQPQHQVDCSAVGGPVAAREKPPVSRLGSAHQGLPTSAFEGACHALGDPGIFTGLEAGDRTVSVPG

SEQ ID NO: 785561 - protein, 93 aa, Homo sapiens
EAECKEELLKDDSSEHGSHRPTAKRRCSGDIATSLVTRALKCVCQGHHDHSLKEFNMLIADALDGPLDFCDSCHVQPPGDEEEGLFQPSKEQA

SEQ ID NO: 785562 - protein, 150 aa, Homo sapiens
AKSGPLLLVCRVPPGLSCPGRETVTGAIGGRVREGRGPARSRLLVTVFAKRGGRPGEGGALVRAGPQGGACGEGAHSGLAEGRQGRGVYGRGQALALVEEGHQAPHLVQGLRLHEDIVLGEQQRGDLGELAHRRAVRVGDDGSQPVQRVV

SEQ ID NO: 785563 - protein, 83 aa, Homo sapiens
LLRVGVVETRTPQNLRMTIARQLAEILLRGMCEQSYWNPVEDPPCQSPLDDPLRKGANTKTYTLTRRARLKEQTPKIQYISRY

SEQ ID NO: 785564 - protein, 90 aa, Homo sapiens
IGRGTFSEVQDHMLIGTQMAIKIIPKAGSLGITLQRVISILKLLCHFNIVRLYQVIDTPNTSYLFSNGVCKRRTPTQPIHHHGLMREEKA

SEQ ID NO: 785565 - protein, 104 aa, Homo sapiens
PLSGTSQRPGVSQGSPPQARSSAPPGPGKLYLPHLHPGLGVRAAVGLGSTGTGFVLRESGFPNHPRGHCVSLFSQMWLCEWGCLAPPGSISGLPRPSPVGGQRP

SEQ ID NO: 785566 - protein, 134 aa, Homo sapiens
EGKGSRQLASSVPICFPERGEEISEDAMPEWLTLQENRRTKAGLYCRNLGSLQPPCQILLPQPAECLGLQAPAATPDWFLYFLVETGFRGVGWAWSQLLTSSDLPASASRGAGIADGSLAYSVLNVAQVGVQWR

SEQ ID NO: 785567 - protein, 84 aa, Homo sapiens
MRNNQWEVEEIPGPCLVLLQSCFVTGDRARRHLLSWRAVMFRLLLINRFEILKYTKLPAWKVTVIAMDMIGFGGIKPSQFAVST

SEQ ID NO: 785568 - protein, 141 aa, Homo sapiens
MLGFLFPKSGGPAGELGQWAGGKPPKAEEEAARHPGRKARGWNGEQRKPPVAKKDGSPAEERRNHAAPKASGLAATHRLMSRITVLKAQTPPKPCPDATLRASEGLTTAAEKSRASSTTGKDNSVPTLATSQWKARAPLWN

SEQ ID NO: 785569 - protein, 67 aa, Homo sapiens
PRYEPPAHLHHHSSANQCLAFSWAAFQLDSLRAPRVGGFSPHLMGREAGTCPGHTASEGAAGIQIHV

SEQ ID NO: 785570 - protein, 126 aa, Homo sapiens
TQEFACANLCTGMPWVLEHPSTAGRMALGLHTVGLLGPNRTSSCGRLPWPRSHLVPQCPKVQFSFVLFLEQCPFPAGEGTALIWDHKIMHYDSLTRLLLETPPGPVSTTAISSTRGCARFSEPSRR

SEQ ID NO: 785571 - protein, 94 aa, Homo sapiens
EEGGSAGQEEYLGQENYACVREALREWLWKLSTVALNPRGIDHPAHAEGIKLQIEGEGVESQSIKNKNFQKVPDQKGTPKRLQAEAETAKGEPC

SEQ ID NO: 785572 - protein, 75 aa, Homo sapiens
KKHCPNQYQIYSESFKQHDITGRALLRLTDKKLERMGIAQENLRQHILQQVLQLKVREEVRNLQLLTQASSEGSP

SEQ ID NO: 785573 - protein, 68 aa, Homo sapiens
TGPAGDRYHFGPENLPILAEKVLEIRSACVEDSPLTHRFRPEPLPTRPGTRGRFLGITPRPNRKHNHS

SEQ ID NO: 785574 - protein, 74 aa, Homo sapiens
KHSSDLELRKEELGIQLDEKWLGDPGAGLRWGCWSLQGRRIPLPQHQLQSQGGQGGQRSSRHGFKPPCLQTSPA

SEQ ID NO: 785575 - protein, 154 aa, Homo sapiens
PPPIPIPSSAASLPEKPRGAEFGATSDPGWDLRVGFEAGTCQGPPAPQNAISSRELLRLSGGAKHWHPGSRQRVARARPSHIPLTHPVCAGREGGLVQPPPPATRTNSGKEQDGAEGARGGATEQITRRSRRAAPWAGAWLGGRMGDAHQAAPL

SEQ ID NO: 785576 - protein, 112 aa, Homo sapiens
MSLLMAGACLSLILVSVGSIPVPGTVALEMEGIEGEQILKHSLHLSLLPSHPPVFQPEAFALRPRLWPTYHRYPSSTGKGNLKRKRGTRDEDTPRKDHVKTWREDSQLQAKE

SEQ ID NO: 785577 - protein, 110 aa, Homo sapiens
RASLMPPPDPRGNPLMDATSYMCRISLSVFQFLGDQRQELVAFHRLATVYYSLHMYEMAEDCYLKTLSLCPPWLQSPKEALYYAKVYYRLGRLTFCQLKGSCRLAQGRPN

SEQ ID NO: 785578 - protein, 154 aa, Homo sapiens
LQISLEGYEKALEFATLAARLSTVTGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 785579 - protein, 150 aa, Homo sapiens
MSEQMMQSVGCRISLSVFQFLGDQRQELVAFHRLATVYYSLHMYEMAEDCYLKTLSLCPPWLQSPKEALYYAKVYYRLGRLTFCQLKDAHDATEYFLLALAAAVLLGDEELQDTIRSRLDNICQSPLWHSRPSGCSSERARWLSGGGLAL

SEQ ID NO: 785580 - protein, 150 aa, Homo sapiens; identical to SEQ ID NO: 785579

SEQ ID NO: 785581 - protein, 95 aa, Homo sapiens
RPAASQHSHLPRASGSPAHEQLTPPSTAFQAHLDSPSQTFPEQLSPNPTKTYFAQEGCSFLYEKLPPSPSSPGNGDCTLLALAQLRGPLSVDVPL

SEQ ID NO: 785582 - protein, 137 aa, Homo sapiens
REAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPF

SEQ ID NO: 785583 - protein, 171 aa, Homo sapiens
MRTYWLHSVWVLGFFLSLFSLQGLPVRSVDFNRGTDNITVRQGDTAILRCVVEDKNSKVAWLNRSGIIFAGHDKWSLDPRVELEKRHSLDYSLRIQKVDVYDEGSYTCSVQTQHEPKTSQVYLIVQVPQRSPIFSSDGHCELRPQRDLVCMANGVLNLNHWRHLTHGSARG

SEQ ID NO: 785584 - protein, 126 aa, Homo sapiens
MLWYGLLGYLRLPCKQLWPDWIPGRGQQTKECSVGSASSDLQDHPAEIRSNSSPRAKVSYGRKLNLWKWPSMATLYYRCSCTKPSGYHMSWVAAPPLCLSSGCCISETCRPAITQCSPTRMEDLCF

SEQ ID NO: 785585 - protein, 100 aa, Homo sapiens
PARCCEVSINLSAVPVPRAVTCGAPFPALERPAEDAEKQRESSPADCTRGLPKSDPSTTGCAEREDPSLYPQPGPTPGSLLLRVYRDEGQSVKLQILDPQ

SEQ ID NO: 785586 - protein, 160 aa, Homo sapiens [sequence omitted]

SEQ ID NO: 785587 - protein, 109 aa, Homo sapiens
SDGLGTRALERRGCGGRLSRAAAAPWARDPCREERADAGGSASGRLEAQHPGGAGARERQNCSNLLSLPHPQRPNPGRVSATLAATPCRALPARLLRRRGLRHCRPRAV

SEQ ID NO: 785588 - protein, 120 aa, Homo sapiens
SAQPHQVIPTLYAEVEGTSSGGGLRNHMADMPQCGASWKHSWLSRPAAGTVHLAPGTAVYGFSSRWQFEFDLQGSKRKLNLFKRKTTLQKLPVFQGTTFDDVLLLLVTGNKRIQNLRDTA

SEQ ID NO: 785589 - protein, 103 aa, Homo sapiens
MTQLRENIQWLIVTCGRRSELHGFAFMFLFVSLQPSFPPSPRCPPRVPLLQPGESDPCFLNFSEAYLHLCFCSTLLSPLYTNYSPVLSKLFPSARLTSSTISF

SEQ ID NO: 785590 - protein, 134 aa, Homo sapiens
QRAGFFIKEKESPPPPLHVDLNETNLINTRKKVCKWASICRLSTCVTQVIKVILVVNPCDSVPGSPPRRTPDSDPQILSVRGSSGLRTPPRARAGTHAHTLTRLLAHRQCLSFPPGTPGQPGWMNKLQLAAALR

SEQ ID NO: 785591 - protein, 224 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKVVKVPQKTLLMDALKEESEIIYDFCMCNPPFFANQLEAKGVNSRNPRRPPPSSVNTGDSLEPGRWRLQ

SEQ ID NO: 785592 - protein, 113 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGISF

SEQ ID NO: 785593 - protein, 504 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKVVKVPQKTLLMDALKEESEIIYDFCMCNPPFFANQLEAKGVNSRNPRRPPPSSVNTGGITEIMAEGGELEFVKRIIHDSLQLKKRLRWYSCMLGKKCSLAPLKEELRIQGVPKVTYTEFCQGRTMRWALAWSFYDDVTVPSPPSKRRKLEKPRKPITFVVLASVMKELSLKASPLRSETAEGIVVVTTWIEKILTDLKVQHKRVPCGKEEVSLFLTAIENSWIHLRRKKRERVRQLREVPRAPEDVIQALEEKKPTPKESGNRQELARGPQERTPCGPALREGEAAAVEGPCPSQESLSQEENPEPTEDERSEEKGGVEVLESCQGSSNGAQDQEASEQFGSPVAERG

SEQ ID NO: 785594 - protein, 143 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTQGRACPVALEPGYPRAKMARGHLASTPYLEQP

SEQ ID NO: 785595 - protein, 107 aa, Homo sapiens
QETTQSPRRGTLTPCEVHELHPIHQTRRAHGRSGKPTPLANQHPSTVCSKFQNPCSCLQHSAHTILQMSALPEAGRLQRSAHTILQTSALPEVGGVSSLLTRKSFAL

SEQ ID NO: 785596 - protein, 141 aa, Homo sapiens
WGAWVRCLRPACIRSWLRLFTVCGPGPQFLPLYNGDNNIPASWELAGLQESKSLELGRQAWGPKEGPQLWIWTPLLEISLPEHPPSLRGHPIGPLPSGGPKLQPPPPPTALPALPDPDAPCSSFLCLDAVDIGDVPCMAGC

SEQ ID NO: 785597 - protein, 214 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTSFHSYKTAHVDLQDKRQVKTALEQAEWQPGRGLFDHDNLMQST

SEQ ID NO: 785598 - protein, 230 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGG

SEQ ID NO: 785599 - protein, 195 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDS

SEQ ID NO: 785600 - protein, 352 aa, Homo sapiens
RPAARSQRERSALGCFPAEGGELLMGKKWRDAAEMERGCSDREDNAESRRRSRSASRGRFAESWKRLSSKQGSTKRSGLPSQQTPAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTSK

SEQ ID NO: 785601 - protein, 123 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVSPECCRFP

SEQ ID NO: 785602 - protein, 89 aa, Homo sapiens
SRRRSGEPAFPVRNAERGPRVCRALKEGKGGVGPERVVAWGASCWGDSEQMSLTELQDSPEGVMWIMYTARSLSLERLPAGFPPLDHHL

SEQ ID NO: 785603 - protein, 101 aa, Homo sapiens
SRRRSGEPAFPVRNAERGPRVCRALKEGKGGVGPERVVAWGASCWGDSEQMSLTELQDSPEGVMWIMYTARHTKRPTKRHAKTPADPHEEATLSVRYRARS

SEQ ID NO: 785604 - protein, 85 aa, Homo sapiens
RALGAPRRVCPARLGFPSPSSSPSVTTPPTSSALRARPVRAESDGLWLHASARAHLLPGTEAQLLGEAESFWSLTLGFHPEQPPK

SEQ ID NO: 785605 - protein, 52 aa, Homo sapiens
IRGLRFCFLVLSLLETPHGLPTMGYASKGVPWTEFSPMTGRKNTETREVRPV

SEQ ID NO: 785606 - protein, 111 aa, Homo sapiens
GLTLFSDSARLHPGEINSLVAHTKPVWWSLHTNAHEIWCHDSDRGTSLGRSIPSPPALCSVRKIYLGPQVLRLTSPRNISPISNLDPTENRTVQLIWQPLPEPLELWPKPL

SEQ ID NO: 785607 - protein, 111 aa, Homo sapiens
PTLPLPQVTTVLIFFTSMFYLLQYFKLVGILQQLFSCVYSLVQRNVCKIRPCCCSILMSSISCYEHIIIGLFVHFVGGGGISPQIGAIMNKAAMNIHLQIILWMYIFISFL

SEQ ID NO: 785608 - protein, 180 aa, Homo sapiens
RSSRIRVHPTPAASTMPPKFDPNEIKVVYLRCTGGEVGATSALAPKIGPLCLSPKKVGDDIAKANGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 785609 - protein, 112 aa, Homo sapiens
SHTLIYTLPLSPNSYSHTYTHTLIHTHSHNHTSTQSPTLTHSYTHSPTQSPLTHTHTHTHTLSHTITLPHTQSPLHSHILIHTLSHTLALHTLPTRTLIYTLIHSHTHMHSH

SEQ ID NO: 785610 - protein, 237 aa, Homo sapiens
AGDPGSPRRVQLGRFDRRRDLTPPGVGVPSPSPSAAPVIVAMDDTLFQLKFTAKQLEKLAKKAEKDSKAEQAKVKKALLQKNVECARVYAENAIRKKNEGVNWLRMASRVDAVASKVQTAVTMKGVTKNMAQVTKALDKALSTMDLQKVSSVMDRFEQQVQNLDVHTSVMEDSMSSATTLTTPQEQVDSLIMQIAEENGLEVLDQLSQLPEGASAVGESSVRSQEDQLSRRLAALRN

SEQ ID NO: 785611 - protein, 79 aa, Homo sapiens
DDGRNRARYLLECLLCGSKVIIIHECNNCHTCHNNPATIVLQSSNMLHPCKGLRPVPEIYDSHYYDSLSGIISESQMIS

SEQ ID NO: 785612 - protein, 675 aa, Homo sapiens
MPTVCSRSSAGTRKHAGEGASPARCLRSPCQVPNRPHCRLPHVAARGNPSSGHHAGEASPLWGLALVFYVEMNESHTPACARPSRQRRRPQALPPSRREGLAHSRLPRRFSSTLPSTLPGWFLPAADAWEPRERLPVPAGSLERSGEPAPETRPPPPSPLSPFLFVSPAPPPPPPPRPPPPPPPPHTTTTTTTTTTPPAGPRPRRPGSLPGWGGLSQGGSPPFMKGWSLPARGPLQGRLAGWLAVRAGLLAAPAAVHSPAEVHGSPPASLCPRPSVKLRPGLTAMALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGISQPAPARGDFAYAAPAPPEPGRSPTLRLLGGLRTRAKAGRTGTRSATACRAPARWHSLGPLKRGRRAKGCLRHPRPRGVRGGAGAGVPRSPGRRGNPKPGQLHLPSPRPREPASARQGQMQGIPAPSQALQEPAPWSALPCGLLLDELLASPEFLQQAQPLL

SEQ ID NO: 785613 - protein, 356 aa, Homo sapiens
ACATSWPASATRTAWLAASAPGTNWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNG

SEQ ID NO: 785614 - protein, 75 aa, Homo sapiens
QLLSRVHHHLHSNSVQAMQLLSGVHHHLRSNSVRPMQLPSGVHHHLRSNSVQHVQLPSGVHHHLRSNSVRPMQLP

SEQ ID NO: 785615 - protein, 90 aa, Homo sapiens
MLSSVIKRSLGAWCVPGPDVGLGHVPVLTSSGLLGESRVRRTQRPGGLGPVWVALRLQKLSLPAESGRAGYTCPELAGSGPFGVPRVGTQ

SEQ ID NO: 785616 - protein, 137 aa, Homo sapiens
QFKSINQGKRTSVADSMLWLLEKYSQNLEDLIQEQTEELELKREKTERLLCQMIPPSVAEARKMGATVEPGYFDQVTIYFSDIVGFTIISALSEPIEAVGLLNDLYMLFDAVLGSHDLYKVRIPGGWHSIPPFTTVP

SEQ ID NO: 785617 - protein, 181 aa, Homo sapiens
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 785618 - protein, 181 aa, Homo sapiens; identical to SEQ ID NO: 785617

SEQ ID NO: 785619 - protein, 181 aa, Homo sapiens; identical to SEQ ID NO: 785617

SEQ ID NO: 785620 - protein, 69 aa, Homo sapiens
MVKLTLGLVPRGTVMGSLLGKVLCLQLSLDDHVVAVCAGNKIFMLDIEVRLKFTWISRKGLADGASQVL

SEQ ID NO: 785621 - protein, 193 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQGLVPRGTVMGSLLGKVLCLQLSLDDHVVAVCAGNKIFMLDIEQRFSVTYIERPDVNNRHKVPPPTFLHTFSQTQAVRAELQGH

SEQ ID NO: 785622 - protein, 173 aa, Homo sapiens
MENPQDIFSSNGGCLSDIVIEKYLVESKESVSHVQLACSMQDCAFPLDGTELCIWNTKDPSHQLLILRGHHQPITAMAFGNKVNPLLICSASLDYVIMWNLDECREKVLQGLVPRGTVMGSLLGKVLCLQLSLDDHVVAVCAGNKIFMLDIEVRLKFTWISRKGLADGASQVL

SEQ ID NO: 785623 - protein, 66 aa, Homo sapiens
LLQQPHPLAQAGLAEHCRGQVQPPCSKAQLPDQTRSKAIRSSKDYFHSIFIDFYHSLGLYRALSLP

SEQ ID NO: 785624 - protein, 134 aa, Homo sapiens [sequence omitted]

SEQ ID NO: 785625 - protein, 151 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVM

SEQ ID NO: 785626 - protein, 213 aa, Homo sapiens
MRFSQQREAKPFRSRIIHLPPFLFASSSHMGLIPSLKRWKSLWPVRSPVTSFFEEMEVTVACQVPRTYHVAIKPPELLHRGKGANLFDILFIALLSSWDGRGFSWSTKKCSCTAGDALPVQDNSLSLATALILVSFRFFLLTIFLCAVFFILIMVPTVIIFQSVELVVHPLAAAGEIDLPVKGGHDTADEKTYGAVMLDSQVKANKFIGHIGR

SEQ ID NO: 785627 - protein, 118 aa, Homo sapiens [sequence omitted]

SEQ ID NO: 785628 - protein, 163 aa, Homo sapiens
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMEFYRQAQGRRWLASLYPGFHQLKSPLTQADPMDYWAGKLGQILVLEIAEDSDRKLET

SEQ ID NO: 785629 - protein, 101 aa, Homo sapiens
ESQPCHRHCCTLPPRGSWTWLWQKKIPGRKAILGNTVKSKQCILPVSSVKMMKVGLWERGPPPPARALHVRPTAVSASGAWSLEAALHWIQVTHLYSWLFE

SEQ ID NO: 785630 - protein, 151 aa, Homo sapiens [sequence omitted]

SEQ ID NO: 785631 - protein, 353 aa, Homo sapiens
MVGDTLKLLSPLMTRYFFLLFYSTDSSDLNENQHPLDFDEMAFGKVKSGISFLIQTGVGILGNSFLLCFYNLILFTGHKLRPTDLILSQLALANSMVLFFKGIPQTMAAFGLKYLLNDTGCKFVFYYHRVGTRVSLSTICLLNGFQAIKLNPSICRWMEIKIRSPRFIDFCCLLCWAPHVLMNASVLLLVNGPLNSKNSSAKNNYGYCSYKASKRFSSLHAVLYFSPDFMSLGFMVWASGSMVFFLYRHKQQVQHNHSNRLSCRPSQEARATHTIMVLVSSFFVFYSVHSFLTIWTTVVANPGQWIVTNSVLVASCFPARSPFVLIMSDTHISQFCFACRTRKTLFPNLVVMP

SEQ ID NO: 785632 - protein, 160 aa, Homo sapiens
MEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECG

SEQ ID NO: 785633 - protein, 85 aa, Homo sapiens
QGTLMQGVGSQGLRQLCSCNSAGLSSHSCSQELALSRPVAFPGTQCKLLVDLPFWDLEDGGHLLTAPLGSAPVGKQCGSSNSTFS

SEQ ID NO: 785634 - protein, 97 aa, Homo sapiens
SLELLQGLRVSLSEVLSVVHAVLCRALLRPQGRAGWPARPAQKGRWGAFPGKAAAPPFTARRLPRRAERRLWAARAAGVESCWPSPREGDVGRAEQF

SEQ ID NO: 785635 - protein, 85 aa, Homo sapiens
DCELPSNQCKKGNQISHVTYAVHKLKTKHVLRESTAPLVLAKKILPKDPRKKKSLGFIAGYKLLATKCHWQVSYSLIEAALHWSK

SEQ ID NO: 785636 - protein, 850 aa, Homo sapiens
EGRWGREVGRPGGLRAGSGLRGAASRWTPARQRKASSPPPSKVNFAAPSAALPSPRRRRAAAVREEPSCVRASFPAPARGHCAMDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLITGIIYPQNKDGEPEYNPCGKYMVKLHLNGVPRKVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHRDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 785637 - protein, 896 aa, Homo sapiens
EGRWGREVGRPGGLRAGSGLRGAASRWTPARQRKASSPPPSKVNFAAPSAALPSPRRRRAAAVREEPSCVRASFPAPARGHCAMDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLITGIIYPQNKDGEPEYNPCGKYMVKLHLNGVPRKVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 785638 - protein, 617 aa, Homo sapiens
NEGPCSKILIQCKANFENKLIVLKEKLISDSKRQANELISFKNQSQERLNKKKTDYEKELLEKSRKLALTVKGKELSEEELHEKFNQLWKKWVCDVSTTLPQVTEPDIDLDSENILWEYFKNKTNVVGLLTNSAEKFQINYDKHIKVNKKYNHIPMTLTVFEKEFINMTTDYIVSRFNKIINNMWKQQCGYNPNYFHEILKTIEEEVKSASTQKRYTFTNTFIIDLCVCLFQRARENFKEMHRAFKRANDPVNYLESKKDDFFTSFKISCQGATSIKTFVDILWYKLTPAVSTTIWEDMTFKIAGDMRATCPAFNGNRTNLEKHILFSLAEEENFDNYWEYLHNSKSFFRSYIKNHIKRYCSDNGGEKMKTFFEKSLIDIKNTILSAIHESTSVAKDKSSTASEWLDLFCDCLGCNLIFPRRDLISIEHQEIKHTEFLKEAMSAALDLTMKKIEQNYSSKPIEAMVSKIEKMLSEHLCGCWKQCPSCGAICTNTIPTHEGDHSVPFHRPQAVNGEEWYETDDFVIDCCTSLVASDCLLVLRDGRNFPFKNYRQAGGDYAMWSITPDTSIQLYWKWFVSHFRSNLEEKYQKKFAGKGKIPNAWAKITKQDVLEDLKKQ

SEQ ID NO: 785639 - protein, 76 aa, Homo sapiens
TENALGNHTEGKQPTPKGHSLHDPMHTTPLKYKITKIENRLAVCVGLEKADMTDLHGDGAVLMFCVLAVSVPRSWC

SEQ ID NO: 785640 - protein, 75 aa, Homo sapiens
LSRGSEGDSRTPEIHAHREKAMWGYSKKVVICKPRREASGETNLQTPRSWTYSLQNCEKINICCLNYPVYGILLW

SEQ ID NO: 785641 - protein, 99 aa, Homo sapiens
KERIEREQQQVVLSMDVGKGEGRGHRPLVFAAFTMGQSRESWLWGEGNVDGFGICLVFHYWNAKHVGVVSYCSRSLPRSDGKNSKNCNLKHKWIKLRQV

SEQ ID NO: 785642 - protein, 139 aa, Homo sapiens
LLRGRKDGCNIGRHEPRQVPRAYLSSLLIVSLLNCEIYNCASHVLGQWMVLFFLVFYLPFWSPRSKKDTNKACILKIPIFNLLSGNFEKSHYYRIISKKSPSFRFCFWLCRSRSLRQWEGLGVTSMAVRRSDCAACDFL

SEQ ID NO: 785643 - protein, 50 aa, Homo sapiens
MLGVLAFSSKALKDTRTLAVSWYRTWSVKVLIPNPVNFPGINLLFVRGTG

SEQ ID NO: 785644 - protein, 103 aa, Homo sapiens
EIAGREVGCQDGEEEGSQEQDELHHRDTKEEEPFESSSEEEFGGEDHQSLNSIVDVEDLGKIMDHVKKEKRDKEQQEEKSGWFRNMGRNEDGERRAMITPAYS

SEQ ID NO: 785645 - protein, 244 aa, Homo sapiens
LYRSPCPISISYEMSDSQDPTTSPVVTTQVELGGCSRQGGGNGFLRFRQHQEVQAFLSLLEDSFVQEFLSKDPCFQISDKYLLAMVLVYFQRAHLKLSEYTHSSLFLALYLANDMEEDLEGPKCEIFPWALGKDWCLRVGKFLHQRDKLWARMGFRAVVSRQCCEEVMAKEPFHWAWTRDRRPHHGGVQRVCPQVPVRLPRGPGLSPPHCSPCGLPQHCSSHLLKPVSSKCPSLTSECHRPPSQ

SEQ ID NO: 785646 - protein, 112 aa, Homo sapiens
QASLDSKLSLKSCPNLFSVLPCTAHICCNPFYAHLLPSDKPSSNPTSTPALPASPSPPANSCTHSQHWFMSFHLSFYIDTNRSLLKINAIIGYIVLYSSFFSYVLSFHITSG

SEQ ID NO: 785647 - protein, 217 aa, Homo sapiens
KKERRKEKKKEKKREGSAGGGGAGSRLQAEMLQMDLIDATGDTPGAEDDEEDDDEERAARRPGAGPPKAESGQEPASRGQGQSQGQSQGPGSGDTYRPKRPTTLNLFPQVQLSQDTLNNNSLGKKYSWQDRVSRSSSPLKTGEQTPPHEPICLSDELPPQSSPAPTTDRGTSTNSPTLLVDEHAQLELVSLRPCFGDYSDESDSAIVYDNCVSVSSP

SEQ ID NO: 785648 - protein, 108 aa, Homo sapiens
METWAVHPGPGARALAGCTQLLPRGTPSSPAPGLPPQRRKGSKGTAGEEPWDSSRAQTPREETRAPGTGRGGGQGQGEGIEFSETLAGLKEDGKSVKSPCAARGGLGY

SEQ ID NO: 785649 - protein, 277 aa, Homo sapiens [sequence omitted]

SEQ ID NO: 785650 - protein, 575 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVTKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMAPVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLGSLWAAGQELQAWKSPGADLLQVLTKAVKSAEAAAEATKNMEAGAGRASYISSARLEQPDPGAVAAAAILRAILEVLQS

SEQ ID NO: 785651 - protein, 204 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVTKAMDPRGSWCAPDKDGNRR

SEQ ID NO: 785652 - protein, 339 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVTKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLMESQTRSGSSRVP

SEQ ID NO: 785653 - protein, 185 aa, Homo sapiens [sequence omitted]

SEQ ID NO: 785654 - protein, 258 aa, Homo sapiens
TGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 785655 - protein, 106 aa, Homo sapiens
MQAPRVQRKEMEVQGRQVTWQPSLGKALLDPAVPVPHQPHMPKSHVPLGLPCWLLSHGRWFGDELLRGKQLLIPQKFCRSSVHFGFYLKCDLNSLLYLILPVPQTE

SEQ ID NO: 785656 - protein, 78 aa, Homo sapiens
GAPWSAGQAHGQAIALPSVYSGQNKPRIPKVQPVVTQLVVTSVFMLRPWEEQEQRGQNVESRIQNGAKGGSGVEAGWG

SEQ ID NO: 785657 - protein, 107 aa, Homo sapiens
MTGSLPSRRFQLKCQFPEWPFLISPYKATLLPAVILHRRTLFILLEALFTLCKSFIELAYLFLPLEPESCAGEIIHCFLSIESPVLTIVHWKRLINIHDISDCMHNK

SEQ ID NO: 785658 - protein, 103 aa, Homo sapiens
MEAHVLAYPHDALLRTLGVLASWVGSLSREPDRAREAPELRRRVIHYYERSVPVHCGVSTFCISPCEPSSDFANASSLMSTFFSKRRQAAHSCVQNAFRMRLS

SEQ ID NO: 785659 - protein, 104 aa, Homo sapiens
NASPPLDCTWHGQEHARCTHLSPQYVALCLEHRPCSVTISGMDVESAPMNGDSEQSPISFQFCFRRVSSGNRVFVWDLTFLGKRGEKPHTQTWPASVEMMSGHA

SEQ ID NO: 785660 - protein, 102 aa, Homo sapiens
FFIPQFTKTYRGVYVSFIHNSATGGTNLIIKRIIVPGKWIPGALAICFPGKSIWLSGKSHLPSAEGEGKSKLRKGNIFLLQNHQVLPVPFTLSRSFFRLYTN

SEQ ID NO: 785661 - protein, 54 aa, Homo sapiens
ERDVLQRELEELKKKFEGMRSRNKLLSSEMKTLKSQMGTLVEKGRHDDELIDAL

SEQ ID NO: 785662 - protein, 116 aa, Homo sapiens
MTRISLARARRSTSRSPPCTSIDENNPTLLNPIKRLAAGSLYAGLLITNNISPASPFQTTIRALYLKLTALTVAESSPINCPEDSMMSMRKLVLSHLFEGKSKSPFIELNLQTESS

SEQ ID NO: 785663 - protein, 268 aa, Homo sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEPIPSPTPRAEPFSANGSPQTELPPTELSVHTPSPQAEPLSPETAQTEVAPRTRPAPYGITPEPRPLAQSPPHPRTP

SEQ ID NO: 785664 - protein, 120 aa, Homo sapiens [sequence omitted]

SEQ ID NO: 785665 - protein, 151 aa, Homo sapiens
MWPPWPISICWNSINWCVGTSVVQWKLMFVQMTLRSFYTGVSDPVEKGRVFAVSWEHVQWQDVNLQQENKPKILSFPIYNKNSESGEGQIFWADRAQRSTLTGHVHLSKETRALVFQSFTDVDFVVQDSVPLGIALFVLCPEPIPAPQKSE

SEQ ID NO: 785666 - protein, 114 aa, Homo sapiens
MICTMACSFYLFPSIRSEPLKSYMHSSWYTSFIETIALLISNSRNLTLECSSITFSSLLMKPLHSQCCTQHCMMQKMVLENSNAFCSLFSFYSVPSCNKFSLFLKQIELHHHLE

SEQ ID NO: 785667 - protein, 250 aa, Homo sapiens
ALPQAAAMAGQEDPVQREIHQDWANREYIEIITSSIKKIADFLNSFDMSVSFKTVQHYTRNGQPFERRIEYMEARVTKGETLTYNSAVLLLEVALHNTGHMGKGPSSLQLLPFSLKEQQGLILVFFFQKVWPWGLCHLGCGWYVGTKFRGTVETTLGILPFPVTFLYIYCVNVISRHSQPKSLGLFVKVLLNSIFLSLSLKISLKFSCAFEWFCEQSWSLPHLVVESAGQSWSRHSCLECGAEMCGYHSS

SEQ ID NO: 785668 - protein, 36 aa, Homo sapiens
LWASGTNPIAFVSSLKMVQSASGTPGAEPWPLHGNG

SEQ ID NO: 785669 - protein, 108 aa, Homo sapiens
RTQTEITRAGRVSLPLSCLVLHVGTHVRSAAACSRAVSGGVVSGHGPPWVTAAPLQSHLPGAGFSGLLWCATFLIGVIGLNTPKDRKGLKGQPLLPVNHHPGTASSAC

SEQ ID NO: 785670 - protein, 119 aa, Homo sapiens [sequence omitted]

SEQ ID NO: 785671 - protein, 112 aa, Homo sapiens
TQQAEKAAAGRTATLPCKSPPGVQLGSSRSSWAMLLGSLWGRCHPGCCALFLILALLLDAVGLVLLLLGILAPLSSWDFFIYTGALILALSLLLWIIWYSLNIEVSPEKLDL

SEQ ID NO: 785672 - protein, 114 aa, Homo sapiens
GRYGTYRGPVTQHVHRGLSRGSGEGGQRAGGVRPDPIHDPDSYPILSPAPLGPFPLRPGSAGSTSSKFVAALRSRACMGWQSWRACVSPPVWHGHVRCAEGLHLLHQVQKATSC

SEQ ID NO: 785673 - protein, 114 aa, Homo sapiens; identical to SEQ ID NO: 785672

SEQ ID NO: 785674 - protein, 114 aa, Homo sapiens; identical to SEQ ID NO: 785672

SEQ ID NO: 785675 - protein, 131 aa, Homo sapiens
GRYGTYRGPVTQHVHRGLSRGSGEGGQRAGGVRPDPIHDPDSYPILSPAPLGPFPLRPGSAGSTSSKFVAALRSRACMGWQSWRACVSPPVWHGHVRCAEGLHLLHQVQKVRMGQGARSFDRQELPGTGLW

SEQ ID NO: 785676 - protein, 196 aa, Homo sapiens
GRYGTYRGPVTQHVHRGLSRGSGEGGQRAGGVRPDPIHDPDSYPILSPAPLGPFPLRPGSAGSTSSKFVAALRSRACMGWQSWRACVSPPVWHGHVRCAEGLHLLHQVQKVQFLQDCALTRPLRGSLCSGPPRPSVVGCPSLSEKGQQGAPNPHVSAGRGRLGHVMLNKSREVESPVSSRPRCGMPTVPPGSLKTL

SEQ ID NO: 785677 - protein, 193 aa, Homo sapiens
RSPSPDHVVKVAEYNKVKLSIFIARLYTTVTRDSSTGFADCRTQRHACTSCLLRNLNTVEKTVYKRDVPCQPCKGQRENYPSPVTKLQEARSQEGKPLSLQNVASTSLMAETAHCTLKPALPTASEINCCNSGTHDAYHSGSSMEPAGSQPFLGPMNSLKRGTEIFLLFVKSLTFPLFFMYTLNCNSSSQIKH

SEQ ID NO: 785678 - protein, 119 aa, Homo sapiens
MVSIGSFLSHPTQTEARSQEGKPLSLQNVASTSLMAETAHCTLKPALPTASEINCCNSGTHDAYHSGSSMEPAGSQPFLGPMNSLKRGTEIFLLFVKSLTFPLFFMYTLNCNSSSQIKH

SEQ ID NO: 785679 - protein, 103 aa, Homo sapiens
PSYHEAPSEEGDRPSPLPGVPTFRFCLSRQQTCPQELCVAFLGCSPAFQKTRVGCLQESPQACVEVVTVPNHPLHRREAHAFGFYFLSICVHTSLFKDKLNLC

SEQ ID NO: 785680 - protein, 120 aa, Homo sapiens
IISWLLGTEGALILSAITQPGIIPTARAELHLSLDGLENICIVSQECRPAQQAMNQVAAPFFTMLGHFLPSYFLHRRRLMFSPENGCWGSQPRSIMPRTAVCQSMKSALESTWLLDQERS

SEQ ID NO: 785681 - protein, 242 aa, Homo sapiens
QHLRQPSHCLVAVADWNPGVLCLLCRPPPPLPGFFPWKPAELTSRVCRFMTSSGGIRREVTLEGLTTALSSQQPQPSNVPLPGPTSPLQRHPVEGPPAGMGSFLAAEPFCSLCEDRGKKCVFLALGSQHCWSLLPAGRGARLEEPSTTEKQRPGVPAPVQVPSHTRCVASGTALPLSGPQFSHYAKRPPSLRYLPTMTVSEFRVSDSGPELQDHQQNGGRERKAVKASWRWGHETQTIRLSD

SEQ ID NO: 785682 - protein, 57 aa, Homo sapiens
MNRHSTTSGNLNTVFGYVDEETVSQGISASYVGSGKLVGNRLVRHTQTSLFSSANTW

SEQ ID NO: 785683 - protein, 108 aa, Homo sapiens
MPTKTTRGGWASLQESWAGLVDSVPLLKPPSSLSIWHGKPICTILFFLWKAHYMILFSAINTNLIEVIRKFLQVTGLQANAADNKIAIRHHQSQTFTVFFLHGNQKTS

SEQ ID NO: 785684 - protein, 123 aa, Homo sapiens
GLSLMECTICNEIVHPGCLKMGKAEGVINAEIPNCWECPRCTQEGRTSKDSGEGPGRRRADNGEEGASLGSGWKLTEEPPLPPPPPRRKGPLPAGPPPEDVPGPPKRKEREAGNEPPTPRKKV

SEQ ID NO: 785685 - protein, 160 aa, Homo sapiens
LWGSSLHFHHHKAGLSCHQFPPGQLQKPSSCSCFHSCSSTIHSARRSQNQNQSSSCHSLDLWLPFALKLKVKIIIMATKSCVVWATSCARLPFIVYIPVKLAFKISAHWVFLPQALAHTCFSLCTCDFLSSPLSKANSDSSFRLHLNDYFLLEDSPNFHN

SEQ ID NO: 785686 - protein, 117 aa, Homo sapiens
SQPILLPLGLYTFQPSNIFRSPILMHITTILPSLLAFVFLFPSLNLLRPGTVVHTCNPSTLECQGGRIACAQKFEASLGNKARPHLYKKIKLPSHLVHLWSQLLGSLRLKDFLSPRG

SEQ ID NO: 785687 - protein, 110 aa, Homo sapiens
TGPLDNSSAPAPPFRLVPPPARPLALKANLIFVSFLSGSFIQVTSIHQMPTPTPPPRTPIWCLSSGESRLLPLLWRGLAKCLQSSLSSTSELPFSSRHRHNSPAHRYHCH

SEQ ID NO: 785688 - protein, 105 aa, Homo sapiens
FKLNYLKLFSLLPPLPDQTCLYYAAHVLESSVPILLAAPAKTSSLSSHPVSNPSASPVNSTLEIYPVPNYTSTSPWLIPWSEPPATSASIWIIAPASPGLLASEF

SEQ ID NO: 785689 - protein, 119 aa, Homo sapiens
HSGQPDFLLSRRCDFRMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 785690 - protein, 119 aa, Homo sapiens; identical to SEQ ID NO: 785689

SEQ ID NO: 785691 - protein, 119 aa, Homo sapiens; identical to SEQ ID NO: 785689

SEQ ID NO: 785692 - protein, 79 aa, Homo sapiens
MQLLRLRIQWHSWEIPPRPCTHLFLSPSFMKAFATALLEKIVRPLRLGVSDIEREIPESVAKNILPNPSAAFYTQLPPS

SEQ ID NO: 785693 - protein, 80 aa, Homo sapiens
EEKVVAIVAGAARPCGVVKEAWFWNRQDITESTEPRVLLVDTSCNTGVGVALEPASASPCPPWSRVLLGPGPRPGPHTSV

SEQ ID NO: 785694 - protein, 67 aa, Homo sapiens
PSHERQYKRRTLDSVNSDPSEIECLSRNYQRHQNSCSAALFILAQSENNPNTHQRVNGSTNCDKFIE

SEQ ID NO: 785695 - protein, 91 aa, Homo sapiens
PWIRARSFPGQRLGAFGPIPPLVPSSPPRLDTVAWHTEAAAEGLRLRNSHPEPAAAMAANLALGPPRVGCPWALAAGFFEPCFLCPAPPSP

SEQ ID NO: 785696 - protein, 142 aa, Homo sapiens
MCLGPAPSWPPTPLVQILHLPPTRGIDIKASPHLAQESETQTAPYTNVVNPSLDLSSTSPESGLWVPAQMPRMHTDGTWRLLKGTGIPGFPESPGRFKWHQMNWKRMKVLLPKVMKFSEDVSVLSGGQTATRGNEPVFSEHP

SEQ ID NO: 785697 - protein, 101 aa, Homo sapiens
NLPHPTLPPRESRLDAARGRHYSPLLRMGSKLGRDAAVGEQQSAFHSLGQGLGGREREVGERTRFQRLSARPRHKGPRGMGAAGRQGLRGVTVAPPPTPGS

SEQ ID NO: 785698 - protein, 68 aa, Homo sapiens
GFTLRKGAALGHHPRVHGHSAAWFENSKYRDSESNVAHICRSSVWVLKSSKARNLEAEDHTCYDMISG

SEQ ID NO: 785699 - protein, 125 aa, Homo sapiens
MTSREASSPCPGQACPGSTPCGQLEQRRPRAAPGFLSKLSCSWGGGRTSAGSSPALGLPGKVGCGRWAGQTPDSWLPHPGLGVVLSLLSAPQPTEIRSLWPGARGSAAPLPSPWPSRSPRQKHPL

SEQ ID NO: 785700 - protein, 86 aa, Homo sapiens
PGILRGGPDRAGGGERKPTGAGPPLTRRLRLPPPGLWAQRAQMPGRTPPPAAGTPIAALEPLGRRNWGLHRHLLLPSPRSLPHLLI

SEQ ID NO: 785701 - protein, 121 aa, Homo sapiens
MDSGPLVAGPSSPPSLSTFGSCSLQCSEPLGTPAAGASAPPTTLLSRLPTPMCFPDCPLVTFRSSLQGATQTPPPASSCRQSSLCLLHAYLFIIKYTKGPIVSLHMFSTQMGKQGGWAVCF

SEQ ID NO: 785702 - protein, 106 aa, Homo sapiens
MQGKGTEGHSPAPLPVISLCFVCSNRSSHKTQFSCISSSSGEHTNKWVFFFSLQIGISDEQGPNPQISRLCKCRFQYQTPTQVQKGTCPYPFGAKFILLNSLKVWT

SEQ ID NO: 785703 - protein, 83 aa, Homo sapiens
KEKIKEKKKKKDKKKGKENKRKKENKRKNVKEKSLVHVLPQPELTPSTGPFTQMYAFSMMFFKEVFDNIAAQESPALFPVRFS

SEQ ID NO: 785704 - protein, 73 aa, Homo sapiens
TGSSWQRLRQLAGIEGLRCLASPVAFVWDARDGGTQITVLSKRATEKHCLFTKLTFYQLSTYNHSIFKCHRVL

SEQ ID NO: 785705 - protein, 77 aa, Homo sapiens
QPSERLRLADGPHGCAGRLEVWHGGRWGTITHSTMIPDPTTTPQPFTTMQPTTMPHPTTTPHPTTTPHPTTTPHPTT

SEQ ID NO: 785706 - protein, 115 aa, Homo sapiens
AHMILEAERSYDLLSVLEAQKPVVWSQSKPVGLRTREAPSLSLKTLRTRNVRVQAQENMVSQLKERESKFASDEDHPHWRWWSSSLGLLIQTLNSPRSIHRHTQKEGSTSYVDIP

SEQ ID NO: 785707 - protein, 69 aa, Homo sapiens
RKIRESCAEPNLYPSSLLLTLDSKAHKAADIVLASKSGLTKCGRVKLRGVCVCVKDPVSLSQAGSLTQL

SEQ ID NO: 785708 - protein, 134 aa, Homo sapiens
MCIQALQREVAEEDLVQVDRAVDALDRWEMFTGQLPATRQDPPSSRDSVGLRKVLGDKFSSLRRKLSARKLARAESAPRPWDGEESYVQQGLPYVSFPKDAGQHCPVAEATTDLPGIKRKGLPGWWLRPVIPSL

SEQ ID NO: 785709 - protein, 112 aa, Homo sapiens
KGSVSNQRTERKAVISHHFRKGLGPAESREEHEEGQSNTLWLFQAFRSFLTPWEEERCVWSRGQVSKGNGGCLEDCSRIVIHSLENIIVFLCILHYGRCVGYRNSSPYHQKK

SEQ ID NO: 785710 - protein, 77 aa, Homo sapiens
MGAAEGHSDPGQEPVPQCSTAKGGDCVTCVCRPTSQTGRRTWVRRHEAGTSQEKLLHPKMPETLRTASLLWKFQGCA

SEQ ID NO: 785711 - protein, 224 aa, Homo sapiens
MNIEVGNISYTGAIISWSSSEPCLEDYYHIMYRPNWNSIFSGYLRYSFHHEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPLVEMPRKNSRDGAELDPEANQDAPDAGALQRGGGDPPAILPHCGE

SEQ ID NO: 785712 - protein, 224 aa, Homo sapiens; identical to SEQ ID NO: 785711

SEQ ID NO: 785713 - protein, 49 aa, Homo sapiens
GTVLAETTLLIQTSSFLFPFLPFCHYYIITELLRYIINHKILGMDIKKY

SEQ ID NO: 785714 - protein, 108 aa, Homo sapiens [sequence omitted]

SEQ ID NO: 785715 - protein, 153 aa, Homo sapiens
MLSSRWWPSSWGILGLGPRSPPRGSQLCALYDFTYTGADGSRCLWLKGIGSYCFERANSDWWLARRLEAPSTLEPSSSQQLYDRGIHPFQSQIRHPRQWSGLLGEVFMVLERLKAPREDREWKAPHSRKVEGDEVTKFELPRTGNLGILQKPH

SEQ ID NO: 785716 - protein, 104 aa, Homo sapiens
VCRLHRGGRAKLFSFAAGRWVAQGKFSSLSCCLPGNGLGAVAGGTVGVKPALRFAWELGEACDCRLSPTSLTTCRDSHNPPRDRQQHNNSGRFQYSTDSTRPAI

SEQ ID NO: 785717 - protein, 81 aa, Homo sapiens
RIRYHIYHHLLLEFSDVRKMTTVAQRNGCFCCPDSEEGHVYALLEANLPPKGLAVCFPRGWSIQGLFWSSRMGLSFSLSSI

SEQ ID NO: 785718 - protein, 133 aa, Homo sapiens
RRAQCSAPRGWAAWGFWGPGGSLASTRSPPSWKCCPTRRASTCSHWAEHRGRWTPARRPARVGEERLRCCLTGGRQPGAPRRRLSLAGPGLQAEKFLPGRGSPPGPWADAPGDGAREDASASAGFRPQAFRAA

SEQ ID NO: 785719 - protein, 35 aa, Homo sapiens
MSGITFHAPRPAPSWEPLGSLRPRLSEAGPSPETQ

SEQ ID NO: 785720 - protein, 82 aa, Homo sapiens
PTKTGDKGRSCLRESSLVVDVPILATSSSSMPVPLLCWLSCLQGGVEIQNHVAPGRVGPGAGLPVWRAGSTGYSPRDLEPAW

SEQ ID NO: 785721 - protein, 238 aa, Homo sapiens
PARLNAPRSHRHPLEWPTGDLHYGLSQEVQQKIEKQYDADLEQILIQWITTQCRKECRGQALKPCDCSRTFAESMAFNEVMCDGVSYCMMLYLIVDLVPAGRQCPPATQTRSKAIRAMGPYNGEHVTTESSRDSLAQHAVMRLYDAFNYPRDYQFQNLCDLVGKDETHGSSVQAVRLMNSGVGWQLARCCGSFSGDPNWFPKKSKENPRNFSDNQLQEGKNVIGLQMGGISGRHDWLL

SEQ ID NO: 785722 - protein, 88 aa, Homo sapiens
SAGGKRVFASGSVGVRSVCRGSALLPPNFLLTGPHCGNNKINKRSKNNIKSQGPGVLTGTGWVQTHTGIPECVPQQDTPALKEWTERS

SEQ ID NO: 785723 - protein, 179 aa, Homo sapiens
SAGGKRVFASGSVGVRSVCRGSALLPPNFLLLQDKFEHLKMIQQEEIRKLEEEKKQLEGEIIDFYKMKAASEALQTQLSTDTKKDKHPLLPPAPYSDGAENVLCEPVTSGPVDVVVLAYLSGTGPHCGNNKINKRSKNNIKSQGPGVLTGTGWVQTHTGIPECVPQQDTPALKEWTERS

SEQ ID NO: 785724 - protein, 420 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEGRKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKALELLMPPVTDNANARMKAHVRRGTAFCQLELYVEGLQDYEAALKIDPSNKIVQIDAEKIRNVIQGTELKS

SEQ ID NO: 785725 - protein, 355 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEGRKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKTMLMQE

SEQ ID NO: 785726 - protein, 146 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKGEIQKIYLLRS

SEQ ID NO: 785727 - protein, 376 aa, Homo sapiens [sequence omitted]

SEQ ID NO: 785728 - protein, 326 aa, Homo sapiens
MMQRIREKSILQAQERAKEATEAKAAAKREDQKYALSVMMKIEEEERKKIEDMKENERIKATKALEAWKEYQRKAEEQKKIQREEKLCQKEKQIKEGRKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKALELLMPPVTDNANARMKAHVRRGTAFCQLELYVEGLQDYEAALKIDPSNKIVQIDAEKIRNVIQGTELKS

SEQ ID NO: 785729 - protein, 381 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEGRKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKEFCSLEGIECQASEPKLSHHIPSDLHVYIQMA

SEQ ID NO: 785730 - protein, 271 aa, Homo sapiens
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLALLLDIMTVAGVQKLIKRRGPYEMSPSLLDYLTMDIYAFPAGHASRAAMVSKFFLSHLVLAVPLRVLLVLWALCVGLSRVMIGRHHVTDVLSGFVIGYLQFRLVELVWMPSSTCQMLISAW

SEQ ID NO: 785731 - protein, 182 aa, Homo sapiens
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLGECACRPPLTVRPLGRQPGLPNPTLAGTCTAL

SEQ ID NO: 785732 - protein, 40 aa, Homo sapiens
MEHPPATHDVIPHLPLPHSPLQFKPTSIIVLLAHTTLLYA

SEQ ID NO: 785733 - protein, 339 aa, Homo sapiens
PYKCNICGKSFSQSSNLATHQTVHSGNKPYKCDECGKTFKRSSSLTTHQIIHTGEKPYTCDVCDKVFSQRSQLARHQRSHTGEKPYKCNECGKVFSQTSHLVGHRRIHTGEKPYKCDKCGKAFKQGSLLTRHKIIHTREKRYQCGECGKVFSENSCLVRHLRIHTGEQPYKCNVCGKVFNYSGNLSIHKRIHTGEKPFQCNECGTVFRNYSCLARHLRIHTGQKPYKCNVCGKVFNDSGNLSNHKRIHTGEKPFQCNECGKVFSYYSCLARHRKIHTGEKPYKCNDCGKAYTQRSSLTKHLIIHTGEKPYNCNEFGGAFIQSSKLARYHRNPTGEKPHK

SEQ ID NO: 785734 - protein, 94 aa, Homo sapiens
MEEFLEPQECYQTAETSWCPSSLPLLQQLIIQAQVADAKQEEVLFSLPVTYLELIYSASQPSGQHGCASITASWMTTSHIDRDLQTITTDRLVY

SEQ ID NO: 785735 - protein, 125 aa, Homo sapiens [sequence omitted]

SEQ ID NO: 785736 - protein, 109 aa, Homo sapiens
SSICQVRMKKTHIPTQNGEQKNFDQNQVLFSCPSTFIYFQVFKYNLCENGPYIYISLQLWPKLQTYIFNLVSSHRHLHLKLSIPQTKLFIPLFTIPPQYCSSLCLPPSP

SEQ ID NO: 785737 - protein, 110 aa, Homo sapiens
EGIWCGLGLYSEGLSSSLPQSFVRSLFQWFLRASGSYAYVLGLQKTLLPRPPYFPEVPLKLHQMFVEPEKIRAGKDLRVLAVQPGKLGSREWERLAQDHKLLGGKAESST

SEQ ID NO: 785738 - protein, 39 aa, Homo sapiens
MWSIRSDAEIKGDGVALLPGDAEQVAGGGDLTLKETDTE

SEQ ID NO: 785739 - protein, 39 aa, Homo sapiens
SENKRFRKAMRITLTQGDICTAGCAVSSPNPSRRMEHSP

SEQ ID NO: 785740 - protein, 123 aa, Homo sapiens
SKDPPGTGVGNCEVLLACVMVLSCPLSSLLVCSGLPEVLLTTFTPGLIHTAASVLRPGAGLLPHLCRRLLISSATLLESHQQCTLLALQEGQGDGPRPVRGASHPPCLPLRASRVPAWGVCVE

SEQ ID NO: 785741 - protein, 123 aa, Homo sapiens [sequence omitted]

SEQ ID NO: 785742 - protein, 124 aa, Homo sapiens
IVLGIQNPISPFFNCPRKHHASLLYAGPVQTTGAQMPGKPAFHAPSTIVLLGELTQLLGEHQSMRESDTPVPLDFSCLIFIFMNIKKIHLLLEFFILHAHMLSDTSLLLFHLDLHCNLSFLFIF

SEQ ID NO: 785743 - protein, 69 aa, Homo sapiens
RKVPAAARMRPRAGAGRSTLPWLPATGQACRLYLSTCEFFPCIYFSLPRLLPALLCKVVSTSTSRVPDT

SEQ ID NO: 785744 - protein, 192 aa, Homo sapiens
NAPRSHRHPLEWPTGDLHYGLSQEVQQKIEKQYDADLEQILIQWITTQCRKDVGRSQPGRENFQNWLKDGTVLCELNNALYPKGQVPVKKIQASTMAFKQMEKISQVSPWPKARGLKARLNGANFKQPKLDIFQTVDLWEGKNMACVQRTLRNLGGLAVAWDDGLFSGDPNWFPKKSKENPRNFSDNQLQEG

SEQ ID NO: 785745 - protein, 44 aa, Homo sapiens
MCALVPSPKQAQLRQGQIQATEDAGPEKANTPTEPLITGPMSAA

SEQ ID NO: 785746 - protein, 69 aa, Homo sapiens
HDPTQKDGDGRVRARKEQHFQVTSPHSGLPFSRVCCDSTPCLQEPRGIRPSELTDDTMTKTFIWDFMAC

SEQ ID NO: 785747 - protein, 113 aa, Homo sapiens
MADPEELQVSSPPPPPPSSPSSSDASAASSPGGPVSLGWPVPSRSSGPTVDQLEEVELQIGDAAFSLTKLLEATSAVSAQVEELAFKCTENARFLKTWRDLLKEGYDSLKPDD

SEQ ID NO: 785748 - protein, 113 aa, Homo sapiens; identical to SEQ ID NO: 785747

SEQ ID NO: 785749 - protein, 113 aa, Homo sapiens; identical to SEQ ID NO: 785747

SEQ ID NO: 785750 - protein, 119 aa, Homo sapiens
GTPSPSRGAVKQPQRGQRGPRIPQHDARAVKGSRRRGDAHGFLGGVVFSTSALRDRLEARAGAVELPKAAFSLTKLLEATSAVSAQVEELAFKCTENARFLKTWRDLLKEGYDSLKPDD

SEQ ID NO: 785751 - protein, 65 aa, Homo sapiens
ISVPWDQPSYQHHCTPLSYTTQHASAFQASLLISPSGLISTWREEREAEQTFLEEPSPLTLPCPV

SEQ ID NO: 785752 - protein, 147 aa, Homo sapiens
KGEEEDGYIEDCYVPQRSIYDTMRINEQIDQGSKLNQTSKSTMEKMEGSTISSNGTLGAASNVFESRAPEGKKLDERIIFDALKLSSDVQKSAPVPPRRRPNAERKDNVNRRSWKSFMPPNFPEFAERIEASLSEVSEAGASNPSLQ

SEQ ID NO: 785753 - protein, 130 aa, Homo sapiens
HIRTGTQEPGAEQSISARKRTKAEAAPGPRPILTPPRLLLQAAGGVQLDPGHNRNAPSTPTSPTAVLPTQRKPASRGSHHPQEASPPCRAGPLPMAGAPSCLPRGTGRGEACGVTTSVTCSPSSMLRVSF

SEQ ID NO: 785754 - protein, 136 aa, Homo sapiens
PTAGSTFGRPGGEAQSSTPRQLKCVCGKGTLGAAGRPPPAEQTRAPGQTGMEVRVQLLPDALGAAQEGEGWGAGCSLAAAAHSCSPGSSGQPLKLPDPPTQAAALCTAEPRPGGAVPPAPAPRSQTAPLRVAAFPG

SEQ ID NO: 785755 - protein, 101 aa, Homo sapiens
HKSPVIPHNKVRKHILTGTWLLLQDVLGQQGLAFTSMVLLIRKLGMNCLIWGEHIHRKRWRESRLVHKLEGVNSLKEGGRRLFVPIKMIQWQVLFMLLHFF

SEQ ID NO: 785756 - protein, 152 aa, Homo sapiens
FPEAQKARKLGANVYTLGVADYNLDQITAIADSPGHVFAVENGFKALRSTIDALTSKVCLDVTSVEPSSECVGEPYHVVIHGNGFQNLKKRDEVICRFIFNESTIIGEYSIEVSLNKGKTFFKSNVSITSTTCTVKEPPPVQKPAKNHRGTE

SEQ ID NO: 785757 - protein, 45 aa, Homo sapiens
MVVSAYWEWTENHVANCCETGSICDLVGWLLSPFIWDQDSDDRCT

SEQ ID NO: 785758 - protein, 181 aa, Homo sapiens [sequence omitted]

SEQ ID NO: 785759 - protein, 181 aa, Homo sapiens [sequence omitted]

SEQ ID NO: 785760 - protein, 141 aa, Homo sapiens
LRPPTQTEPNYSYFLPYILITIQTGLFTIFLYLSLYPSFSLPVWLAHSFNLSSGGFFCLFVCLFVLRWSLALWLECSGVISANCNLYLPGSSDSPVSASQVVGITGTHHHAWLVVFVFLVETGFHHVGQLVSNSSPQVIHL

SEQ ID NO: 785761 - protein, 116 aa, Homo sapiens [sequence omitted]

SEQ ID NO: 785762 - protein, 49 aa, Homo sapiens
MQVYSPGARGRTTQPKSVAGCAIQVCVSIFHDARTTMTLPNDAFLECIP

SEQ ID NO: 785763 - protein, 196 aa, Homo sapiens
MADIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRIKLLTDVGPAKDKFSLGVSAIRCLKMGGLLVGSGAGLLVFCKSPGYKPIK

SEQ ID NO: 785764 - protein, 285 aa, Homo sapiens
MDNKISPEAQVAELELDAVIGFNGHVPTGLKCHPDQEHMIYPLGCTVLIQAINTKEQNFLQGHGNNVSCLAISRSGEYIASGQVTFMGFKADIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRIKLLTDVGPAKDKFSLGVSAIRCLKMGGLLVGSGAGLLVFCKSPGYKPIK

SEQ ID NO: 785765 - protein, 203 aa, Homo sapiens
MDNKISPEAQVAELELDAVIGFNGHVPTGLKCHPDQEHMIYPLGCTVLIQAINTKEQNFLQGHGNNVSCLAISRSGEYIASGQVTFMGFKADIILWDYKNRELLARLSLHKGKIEALAFSPNDLYLVSLGGPDDGSVVVWSIAKRDAICGSPAAGLNVGNATNVIFSRCRDEMFMTAGKYVSAFGVFRTHKLLYFLAQKTWSF

SEQ ID NO: 785766 - protein, 85 aa, Homo sapiens
GPNSWMPCGDITISRRCNKTGATAQGQRNRFVGASGSAVTIEDSLLYFDSKTMRKAPEELRLQPGRRKSEVQGGMHPELVEEIPQ

SEQ ID NO: 785767 - protein, 106 aa, Homo sapiens
MRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVR

SEQ ID NO: 785768 - protein, 123 aa, Homo sapiens
LALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVR

SEQ ID NO: 785769 - protein, 200 aa, Homo sapiens
QLPAHPCLSPSHTLGPWPLQSLSPSVTLPVPPLPMEGGRTAVWWGDRVGPRVWEGPALGAGLRGAPGPHDSLRPGLASLCRAVPLRAVASSHTFGDPASGDAGQRLSSERALTSERATWGQLTPVGPWARNKRLMRPSGPFPDPPCPALSGKQPQRRAGLVVTRSPAPPRASDLCLFCTFLGWDCGASARWGAVCRAVGV

SEQ ID NO: 785770 - protein, 125 aa, Homo sapiens
CKEVSVVGMEWTQEGREAAEMVRPDQRGLLYLVKRDVKGSGGDRRSPYALGKATHTHPFSRIAEPLISFVIFKSHFPFWPPLFLSVRYGSWTNMTFKLPSNSNHLWIWISLRSFLCNECSESCCL

SEQ ID NO: 785771 - protein, 116 aa, Homo sapiens
KEGWCVVCDVTHSDEKHRSLQKCSWRGPSYQRNDKNLPAQSLSVHNFLNLHSNVPYFLPLESILHTTARLCLSLLKTFLGFHSYSNKVLIMANKALQGLFSAYFFYFFPFHSVTMV

SEQ ID NO: 785772 - protein, 87 aa, Homo sapiens
HLPQIKVNRPLRTQPLSSDMVFMEVQGQQFDRCLQEAAGLHAEWASSLEGSVGKHCGRHILSDRALGTAWPAPSLWLCLLRAPRPFF

SEQ ID NO: 785773 - protein, 78 aa, Homo sapiens
HSQSLASILPFPLYSLLWFLRADFRVYCFSHAPTVPFPEPRAIRLKSHSSKVLYHLAIVAIPSRASYFPLLPLVSSCE

SEQ ID NO: 785774 - protein, 125 aa, Homo sapiens
MGDLSRTALWLGGRRDPSGSFRVRDGAAAEVGRACLGLPSECGSLVRARASPRPLLGPAVCPWRARSPRPGLPRPSPTCPWKRGGDWCALSLVAPAASRHPPLSASEQRIPPTSTCTCTRPLGNP

SEQ ID NO: 785775 - protein, 35 aa, Homo sapiens
SCLYVSYAEYHWAAFLEYVFPYTHLLASYLGLPQQ

SEQ ID NO: 785776 - protein, 106 aa, Homo sapiens
GKEPCDFPHLSELGGLCLRRALRREGRSHPHCDLSPPFLAGWLWSVGNEGVGKPGKQKVGAGGLLAGRQTFGANFPAQPAELLVLRYTRVSSVFLLDCVTLLSHCY

SEQ ID NO: 785777 - protein, 270 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRVTGVAMSWVLSLWLVSPSSKRQRLKNLPLNWVKCHC

SEQ ID NO: 785778 - protein, 278 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRVTGVAMSWVLSLWLVSPSSKRQRLKNLPLNWVKCTLLSFLYIKY

SEQ ID NO: 785779 - protein, 211 aa, Homo sapiens
RPTQASGGRAGPREGAGGGEVAGVGGTELARSQSGHPHLIFPSWLEAGEPRPPLPETSVFGSARPLAPLLGLQVSSLGSQDPPMGTALFSFCSGNSKNQDGGRGRVLSCPFIIMTVEFLAVPITPQHDACQNAPNLLPDAGAIAISGHRQLRAALSNGCPWDTSLRDAFVGKGFCGSITFGSAAHSVPKLDIHKGRYCRKGSDKPYRKASC

SEQ ID NO: 785780 - protein, 118 aa, Homo sapiens
MGAVAKDGHNTNSPFVFYLSLQKGVFLNSTLLWACYILSPRLLLLARLVSRWLSCWKKRKPKPASPHPLVRWACPTPSWVHIRPDKKEAKKLSVYHCASSCPPHPISLKWNGLISLFV

SEQ ID NO: 785781 - protein, 118 aa, Homo sapiens; identical to SEQ ID NO: 785780

SEQ ID NO: 785782 - protein, 121 aa, Homo sapiens
MILPEKLHMRRCAGMCVLLEKRPKGSAQRPENPREQGPLGQAGEGLGRDTTVRQQSLRGWRRRPPLSCSSCPFRWRRWMGPGAFGGARGAGEAAALEPPAWQPFGPQGNIGALANRIILSV

SEQ ID NO: 785783 - protein, 244 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMASVVDLD

SEQ ID NO: 785784 - protein, 106 aa, Homo sapiens
CSKIRRSEASFSERPELPVRKISIGETGSLKDQEGKSFNIVWLLATLEDQRYNFVFNLVYQSQHTSVLSCAPTNTTKFMVLARPRYEEDYYKCMGCDDNVVDVVVT

SEQ ID NO: 785785 - protein, 80 aa, Homo sapiens
VVEEAVITSPGSEWPPLPHHLHLPKSDQSDKCLSSFSLEDEVLSTFQPWHLYHRADVILFCIIMITPHIDNSSRLTKPSD

SEQ ID NO: 785786 - protein, 67 aa, Homo sapiens
CLYEHIQIIVEKLSCRRNQCKVSETDSNAKHGMTLAECKRVVDQGSPDIVVIKQVSGMGKNLPRREK

SEQ ID NO: 785787 - protein, 68 aa, Homo sapiens
LSLYFQQTACPGDRSELWSSMQPGCQAYSTGQVPSSCPGIVNVTHTRHNGLGNVERRGASVRCHETSG

SEQ ID NO: 785788 - protein, 68 aa, Homo sapiens; identical to SEQ ID NO: 785787

SEQ ID NO: 785789 - protein, 168 aa, Homo sapiens
LASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPGSSQSEGKKSREQPSVLSRYPPAAQEHSKAWKGTSKPGTESGLKGK

SEQ ID NO: 785790 - protein, 118 aa, Homo sapiens
CIALGGLPQVFPQLSSLWIPSTVYHGDQNPLPWGCPSLSSWESKHAYCYWSSLIFPGCIDLAQCHRWGCVLYKPPQTHIHPIWGEKAVLSTFPLGFKESRKSDILYQVTGNKQKSETH

SEQ ID NO: 785791 - protein, 195 aa, Homo sapiens
AQSEGTPARGARGARPRRRRSGAQPPTRPVGTRTRRDPAPGKGCGDLGSDPEFIPSLLAPRRPDVLTQWSLRMGKPIVTCAHRRQPGHVPRVSAWHASVIHACEELSAWLDGCQIDSAKRDPSVNTLGASPEGLVDYCRNSQGGLHQRALPVEGHTCVRTFDHVARANSVSDERGVIGQRRGPLVRAQSLANVNI

SEQ ID NO: 785792 - protein, 484 aa, Homo sapiens
AQSEGTPARGARGARPRRRRSGAQPPTRPVGTRTRRDPAPGKGCGDLGSDPSSSPHTPAAPCHPGPRWEPYPAPRVSPALARIAGMAVTMLQDWCRWMGVNARRGLLILGIPEDCDDAEFQESLEAALRPMGHFTVLGKAFREEDNATAALVELDREVNYALVPREIPGTGGPWNVVFVPRCSGEEFLGLGRVFHFPEQEGQMVESVAGALGVGLRRVCWLRSIGQAVQPWVEAVRCQSLGVFSGRDQPAPGEESFEVWLDHTTEMLHVWQGVSERERRRRLLEGLRGTALQLVHALLAENPARTAQDCLAALAQVFGDNESQATIRVKCLTAQQQSGERLSAFVLRLEVLLQKAMEKEALARASADRVRLRQMLTRAHLTEPLDEALRKLRMAGRSPSFLEMLGLVRESEAWEASLARSVRAQTQEGAGARAGAQAVARASTKVEAVPGGPGREPEGLLQAGGQEAEELLQEGLKPVLEECDN

SEQ ID NO: 785793 - protein, 114 aa, Homo sapiens
VATAWSDLQCTEMGWEQETQKSRPWNQVEGRQPGHDPEQDTCSTSPFAMSKSSLRPPKKLMPCASCTAAEPDGFPWLCYSHSWKCCLTESSGHPSRMDVVSPPTLQMGKLRLES

SEQ ID NO: 785794 - protein, 129 aa, Homo sapiens
FRRQVGGASPEVLPGPRFSHSFPRIGDHVVSVQSKNHVSWAQAQVRIVVLEAVSGLQVPNCCEPGIAMGTERNFTARVQRGSRVAYAWYFSLQKVRGDSLFILSGRDVTYTPWPRGCWRSRCVPSTPWA

SEQ ID NO: 785795 - protein, 68 aa, Homo sapiens
CPEPGAPWNYASCKHSLGAGLCQSRQGASPGEVHASNSEQGQHPQTTAHSPTVHASLAMVGRGSSSLP

SEQ ID NO: 785796 - protein, 100 aa, Homo sapiens
VIQAEYPSYEKLGITTVLDFEIFALYLTQVEHPKSENPKSKMLQQAFPLSHVDAQKVSNFIAVHFFFFETKSHSVARAGVQRLGSPQPPPPGFKRFSFLS

SEQ ID NO: 785797 - protein, 50 aa, Homo sapiens
QHFKMPCQSTRIGTRSETQLDDHRDLIAQTPNGSIGLMETSAPICFPSES

SEQ ID NO: 785798 - protein, 78 aa, Homo sapiens
MPQRDGCTGWLPWWTVSGSGGDDRGFVCRGWLQVARVTEERGLLRKAAVVQPSLHGLMAFALQVCVGPTCSVPGAGCW

SEQ ID NO: 785799 - protein, 66 aa, Homo sapiens
ALLMQQEERAKQQGDHSLKEHELLEQQKRAAVLLEQERQQEIAKMGTPVPRPPQDMGQIGVRTPLG

SEQ ID NO: 785800 - protein, 106 aa, Homo sapiens
RSEWGGRVLSPLFALLCGHQDSLHPHQVPGAAVLPPFHRGKTGTEIKNHPDAPPQVSRGAGAALGAPQTHCISKPSSDAPLPFQAWRGVQHETLILQPWSPPHRES

SEQ ID NO: 785801 - protein, 564 aa, Homo sapiens
RAIAHWGSGRLGPAWGSCAAGLWVLAPPEPTGHLVIPGTSPLEPPCPWLDSHIFQCRFGKMLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEDARMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPA

SEQ ID NO: 785802 - protein, 119 aa, Homo sapiens
SECFALKTGPDVLPVHNSVHVCVRAHTHTHTHKHTYTLFPSHTHIHTLSLSPLPPYTHTHTHTHTHTHIFTVLVSLCVSEQLYSHISLCVKELFPLEKDRSSSSFSVVSWSDSLFFTFS

SEQ ID NO: 785803 - protein, 194 aa, Homo sapiens
PQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLQGFLTAAIDREGNHRYHFKALDPEFGTVKEEIFHDDDAIPGWARANIVALGAKEEHGRAMNAKVYRLQGLMEPGHSLAAITQDKRNSDTRITTKNVTS

SEQ ID NO: 785804 - protein, 127 aa, Homo sapiens
MGGLNTHTLPLSPSTGAAAQTSLGAPRPAWDCTVPGRVPGEGHKGLGARSRKSVGTGKAPVHPGRDMGQFEQGCGSPALALPGGEAPGPDIRGRRRGNMPRGGRGTRRPPGGAGRGAPGGRRRPLAS

SEQ ID NO: 785805 - protein, 77 aa, Homo sapiens
GKKLDDTENLHQHQKQHIGEKLERRGAREVSFVNSCKVHVSQEPFISYEVGKNFLPSLGLHQQEATHNVEKTNTETK

SEQ ID NO: 785806 - protein, 60 aa, Homo sapiens
MHPFGKLSHVCLSKCGCCGFSFHNGPKTQEQTLGHGDSRSEEWGSHCGCQESRCCLNMGP

SEQ ID NO: 785807 - protein, 97 aa, Homo sapiens
MQSSQLARENVSGGRFRSVFQEASSDLSYLGAKELSAGQKHPEGLWACGQSLLCSCERQDLLPGRQYNFQEMPASCPTCPATPQPWFKLLLEPGTVA

SEQ ID NO: 785808 - protein, 108 aa, Homo sapiens
MSPMLKELSVTSNWHATEVAVGGSVKVLTGQRQERDEVSRAAVAWGGCHNLGTLCGGPGHWFSEGQPRSRSLRVLRCDCRMLLSLGKQVGSLQPMEKSIPWRAIVEVG

SEQ ID NO: 785809 - protein, 100 aa, Homo sapiens
ATFPSIWIPQLWRARAVSRLWTRDGVHPEEGAGGVASRVSQQKLAFLNLNKKTKERWDFGACLIRAQPLPTGPHSTCRAASALTGHERACVVRRDEKAEA

SEQ ID NO: 785810 - protein, 74 aa, Homo sapiens
LNKFSRMWSHTEASTRKVPDARAKYSVYLQAGHRHSEKPWQELPATKQSPAGNASSRALPESLMGKDVQNICLS

SEQ ID NO: 785811 - protein, 171 aa, Homo sapiens
RQPGRRDEAWKSTRLPKDGASVLRVRDEDLFPPTAPGRRSAGPRPLRAAPRTMSVTDQAFVTLATDDIYCQGALVLGQSLRRHRLTRKLVVLITPQVSSLLRDMDEAGNHDSEQTIAGIENQTLHVLTHRWELNNENTWTQGGEHHTLEPVVGRGEGGGIALGDIPNVNDE

SEQ ID NO: 785812 - protein, 148 aa, Homo sapiens
RQPGRRDEAWKSTRLPKDGASVLRVRDEDLFPPTAPGRRSAGPRPLRAAPRTMSGSHSVTQAGVEWYNHSSLQPQTPRLKYPPTSASQVAVTTVTDQAFVTLATDDIYCQGALVLGQSLRRHRLTRKLVVLITPQVSSLLRVSLVAQA

SEQ ID NO: 785813 - protein, 115 aa, Homo sapiens
RQPGRRDEAWKSTRLPKDGASVLRVRDEDLFPPTAPGRRSAGPRPLRAAPRTMSVTDQAFVTLATDDIYCQGALVLGQSLRRHRLTRKLVVLITPQVSSLLSLSKRCKISSSHLD

SEQ ID NO: 785814 - protein, 105 aa, Homo sapiens
RQPGRRDEAWKSTRLPKDGASVLRVRDEDLFPPTAPGRRSAGPRPLRAAPRTMSVTDQAFVTLATDDIYCQGALVLGQSLRRHRLTRKLVVLITPQVSSLLRWIH

SEQ ID NO: 785815 - protein, 142 aa, Homo sapiens
RQPGRRDEAWKSTRLPKDGASVLRVRDEDLFPPTAPGRRSAGPRPLRAAPRTMSVTDQAFVTLATDDIYCQGALVLGQSLRRHRLTRKLVVLITPQVSSLLRICSLTLVSLHGFLKAICMFAAVSALSVYMYCVVFLFRLLV

SEQ ID NO: 785816 - protein, 55 aa, Homo sapiens
MLQSYIVISMTKNLPFPSEGNKLRLRAANSTWFEGSAEDTLTEAPQLKGRKPHKK

SEQ ID NO: 785817 - protein, 245 aa, Homo sapiens
ASAWNGGLIALRMALFSLFWNEHDYRLGHYGAEDHQTPRDGETSHRAQIQQQQSYVEDLRHQILAEEIRAAKELEFDQAWISQQIKENQQCLLREETWLASLQQQQQEDQVAEKELEASVALDAWLQTDPEIQPSPFVQSQKRVVHLQLLRRHTLRAAERNVRRKKVSFQLERIIKKQRLLEAQKRLEKLTTLCWLQDDSTQEPPYQVLSPDATVPRPPCRSKLTSCSSLSPQRSLQQSTCPSYT

SEQ ID NO: 785818 - protein, 251 aa, Homo sapiens
AGRGSLEWLDLDGDLAASRLGLSPLLWKERRALEEQCDEDHQTPRDGETSHRAQIQQQQSYVEDLRHQILAEEIRAAKELEFDQAWISQQIKENQQCLLREETWLASLQQQQQEDQVAEKELEASVALDAWLQTDPEIQPSPFVQSQKRVVHLQLLRRHTLRAAERNVRRKKVSFQLERIIKKQRLLEAQKRLEKLTTLCWLQDDSTQEPPYQVLSPDATVPRPPCRSKLTSCSSLSPQRSLQQSTCPSYT

SEQ ID NO: 785819 - protein, 51 aa, Homo sapiens
AIKEKTARCSLAMTEELLQDLAQYKTHKDKNVMMCARTLIQLFRTLNPQML

SEQ ID NO: 785820 - protein, 144 aa, Homo sapiens
MQVWDTAGQERFRTITQSYYRSAHAAIIAYDLTRRSTFESIPHWIHEIEKYGAANVVIMLIGNKCDLWEKRHVLFEDACTLAEKYGLLAVLETSAKESKNIEEVFVLMAKELIARNSLHLYGESALNGLPLDSSPVLMAQGPSE

SEQ ID NO: 785821 - protein, 61 aa, Homo sapiens
MGDGFRKYFRLESPRFDDKLDESSKLRYHHGDTNFVELENLPYYFLIVLAFHFAAPGPPLV

SEQ ID NO: 785822 - protein, 58 aa, Homo sapiens
RKDTYPFYSEHIARTSHLTLPSRRGTGKCGRAHANAVKNNYFQAVVVAHACNPSTLGG

SEQ ID NO: 785823 - protein, 133 aa, Homo sapiens
ISCRKLELPLMLGTAQRESLSLWLPGLGPQVTECDSLLEILKQSPVQTRTRPPPTYPARPTARKRNSPRGAGTHGTKRVRHLLTSPDMYGTSASTSLSLPEGSCTLGEHLRPQPCGTPLTFTLAPRPSHWFPF

SEQ ID NO: 785824 - protein, 63 aa, Homo sapiens
AVRCLAKNLLGAENRELKLVAPTLRSELTVAAAVLVLLVIVIISLIVLVVIWKQKSEDEFSGV

SEQ ID NO: 785825 - protein, 76 aa, Homo sapiens
MLQASFLWPQNEDKKGEMGHRDEGACSLQQCAHHGCAEAAGGRYWEEALPLCVLGAGHSLMGPLCSQLQKPIHVGS

SEQ ID NO: 785826 - protein, 111 aa, Homo sapiens
MAISFFLFLGQKTYLEPDIESSLSPFFHTSHLIHQKIMSTLSSTTSHHVHHYLRGPSPIISHLDNSNSLLTSLLLPLPLHSLFSKRWPKWPFKTLISVTHQLKASNDFSSE

SEQ ID NO: 785827 - protein, 286 aa, Homo sapiens
LLWLYICTLEAKMQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVEAYLSLPSNNSHTPCGSSLCQRWQTPEIALIDSHKLLRSIIFLLMGSDILSTQESSVE

SEQ ID NO: 785828 - protein, 265 aa, Homo sapiens
MTPDYGGGWAPNRAQGDYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVEAYLSLPSNNSHTPCGSSLCQRWQTPEIALIDSHKLLRSIIFLLMGSDILSTQESSVE

SEQ ID NO: 785829 - protein, 117 aa, Homo sapiens
ITHKNTPLKKVEVLSMEEEKIMEKLGGIFKYFKKMTALLFNNKRTSLGGEAPVRAIVDMTLALGVEVLHGFYLDICCNSSSACYRRNFCDATDLLPYLSLKPQGLQLFTKPTQHSFL

SEQ ID NO: 785830 - protein, 102 aa, Homo sapiens
RQSTSLTCCRGKATKYYAKVSYRPKQKLGYHQETTQECLQVFTNESFCFFLKVKGTTISEISAYIVDFSYPLNVKKDELTNSMTITASSFFYSQNLHSRASH

SEQ ID NO: 785831 - protein, 105 aa, Homo sapiens
MVSPPKRRKDGTSSSGLLHQLRNLIPKTMLSLSHSRTVLGLTGSTLVLYVYPTTDLPGLCHIPKTMWTEKVGKDGSLWSKQGAVTRRRTGCWAGKRNRHPPIHPV

SEQ ID NO: 785832 - protein, 116 aa, Homo sapiens
TENDDGIISTSKFAASFFLITKPLYQSDFNSQRKREISPCSNWVRVRKRRKNTRSHASAEEEPEGRGSEEMSQRAETSMGGHNSMDGAFRKKGMPSGDGKTEPPLVELTWRFVFFT

SEQ ID NO: 785833 - protein, 1120 aa, Homo sapiens
TLSSPRRPPPPTMDPPSPSRTSQTQPTATSPLTSYRWHTGGGGEKAAGGFRWGRFAGWGRALSHQEPMVSTQPAPRSIFRRVLSAPPKESRTSRLRLSKALWGRHKNPPPEPDPEPEQEAPELEPEPELEPPTPQIPEAPTPNVPVWDIGGFTLLDGKLVLLGGEEEGPRRPRVGSASSEGSIHVAMGNFRDPDRMPGKTEPETAGPNQVHNVRGLLKRLKEKKKARLEPRDGPPSALGSRESLATLSELDLGAERDVRIWPLHPSLLGEPHCFQVTWTGGSRCFSCRSAAERDRWIEDLRRQFQPTQVIALRKAGHGDPAHRPGPPLPLYPKPARSITRAPNTPAPPASLQRLQDSPSIYYQPREYQTRPFCPLPAPYAPKALPARQSRSLYSSTTLVCPGAPNSPGEPRKARRLPRNRLLDSRGSTSFPKGPAISLGTRRNRFEAPRFTCGAFFGAANKPKRFPPSHSHLQDNVEREETWLSVWVHEAKGLPRAAAGAPGVRAELWLDGALLARTAPRAGPGQLFWAERFHFEALPPARRLSLRLRGLGPGSAVLGRVALALEELDAPRAPAAGLERWFPLLGAPAGAALRARIRARRLRVLPSERYKELAEFLTFHYARLCGALEPALPAQAKEELAAAMVRVLRATGRAQALVTDLGTAELARCGGREALLFRENTLATKAIDEYMKLVAQDYLQETLGQVVRRLCASTEDCEVDPSKCPASELPEHQARLRNSCEEVFETIIHSYDWFPAELGIVFSSWREACKERGSEVLGPRLVCASLFLRLLCPAILAPSLFGLAPDHPAPGPARTLTLIAKVIQNLANRAPFGEKEAYMGFMNSFLEEHGPAMQCFLDQVAMVDVDAAPSGYQGSGDLALQLAVLHAQLCTIFAELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAG

SEQ ID NO: 785834 - protein, 140 aa, Homo sapiens
MDQPQDRNQALGTHRPVNKLAELQCEVAALREEQKVLSRLVESLSTQIRALTEQQEQLRGQLQDLDSRLRAGSSEFDSEHNLTSNEGHSLKNLEHRLNEMERTQAQLRDAVQSLQLSPRTRGSWSQPQPLKAPCLNGDTT

SEQ ID NO: 785835 - protein, 1180 aa, Homo sapiens
TLSSPRRPPPPTMDPPSPSRTSQTQPTATSPLTSYRWHTGGGGEKAAGGFRWGRFAGWGRALSHQEPMVSTQPAPRSIFRRVLSAPPKESRTSRLRLSKALWGRHKNPPPEPDPEPEQEAPELEPEPELEPPTPQIPEAPTPNVPVWDIGGFTLLDGKLVLLGGEEEGPRRPRVGSASSEGSIHVAMGNFRDPDRMPGKTEPETAGPNQVHNVRGLLKRLKEKKKARLEPRDGPPSALGSRESLATLSELDLGAERDVRIWPLHPSLLGEPHCFQVTWTGGSRCFSCRSAAERDRWIEDLRRQFQPTQVIALRKAGHGDPAHRPGPPLPLYPKPARSITRAPNTPAPPASLQRLQDSPSIYYQPREYQTRPFCPLPAPYAPKALPARQSRSLYSSTTLVCPGAPNSPGEPRKARRLPRNRLLDSRGSTSFPKGPAISLGTRRNRFEAPRFTCGAFFGAANKPKRFPPSHSHLQDNVEREETWLSVWVHEAKGLPRAAAGAPGVRAELWLDGALLARTAPRAGPGQLFWAERFHFEALPPARRLSLRLRGLGPGSAVLGRVALALEELDAPRAPAAGLERWFPLLGAPAGAALRARIRARRLRVLPSERYKELAEFLTFHYARLCGALEPALPAQAKEELAAAMVRVLRATGRAQALVTDLGTAELARCGGREALLFRENTLATKAIDEYMKLVAQDYLQETLGQVVRRLCASTEDCEVDPSKCPASELPEHQARLRNSCEEVFETIIHSYDWFPAELGIVFSSWREACKERGSEVLGPRLVCASLFLRLLCPAILAPSLFGLAPDHPAPGPARTLTLIAKVIQNLANRAPFGEKEAYMGFMNSFLEEHGPAMQCFLDQVAMVDVDAAPSGYQGSGDLALQLAVLHAQLCTIFAELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAGSSEFDSELQPNTQLLGTLIATPRTTASNDHCVSRALTLDERRLADPTTCIRSSTLEIPYR

SEQ ID NO: 785836 - protein, 1120 aa, Homo sapiens; identical to SEQ ID NO: 785833

SEQ ID NO: 785837 - protein, 1188 aa, Homo sapiens
TLSSPRRPPPPTMDPPSPSRTSQTQPTATSPLTSYRWHTGGGGEKAAGGFRWGRFAGWGRALSHQEPMVSTQPAPRSIFRRVLSAPPKESRTSRLRLSKALWGRHKNPPPEPDPEPEQEAPELEPEPELEPPTPQIPEAPTPNVPVWDIGGFTLLDGKLVLLGGEEEGPRRPRVGSASSEGSIHVAMGNFRDPDRMPGKTEPETAGPNQVHNVRGLLKRLKEKKKARLEPRDGPPSALGSRESLATLSELDLGAERDVRIWPLHPSLLGEPHCFQVTWTGGSRCFSCRSAAERDRWIEDLRRQFQPTQVIALRKAGHGDPAHRPGPPLPLYPKPARSITRAPNTPAPPASLQRLQDSPSIYYQPREYQTRPFCPLPAPYAPKALPARQSRSLYSSTTLVCPGAPNSPGEPRKARRLPRNRLLDSRGSTSFPKGPAISLGTRRNRFEAPRFTCGAFFGAANKPKRFPPSHSHLQDNVEREETWLSVWVHEAKGLPRAAAGAPGVRAELWLDGALLARTAPRAGPGQLFWAERFHFEALPPARRLSLRLRGLGPGSAVLGRVALALEELDAPRAPAAGLERWFPLLGAPAGAALRARIRARRLRVLPSERYKELAEFLTFHYARLCGALEPALPAQAKEELAAAMVRVLRATGRAQALVTDLGTAELARCGGREALLFRENTLATKAIDEYMKLVAQDYLQETLGQVVRRLCASTEDCEVDPSKCPASELPEHQARLRNSCEEVFETIIHSYDWFPAELGIVFSSWREACKERGSEVLGPRLVCASLFLRLLCPAILAPSLFGLAPDHPAPGPARTLTLIAKVIQNLANRAPFGEKEAYMGFMNSFLEEHGPAMQCFLDQVAMVDVDAAPSGYQGSGDLALQLAVLHAQLCTIFAELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAGSSEFDSEHNLTSNEGHSLKNLEHRLNEMERTQAQLRDAVQSLQLSPRTRGSWSQPQPLKAPCLNGDTT

SEQ ID NO: 785838 - protein, 1188 aa, Homo sapiens; identical to SEQ ID NO: 785837

SEQ ID NO: 785839 - protein, 80 aa, Homo sapiens
QSAGITDVSHRARPKMFIFCFYFPTCQSPVPEIFIFACPACIHFEGKLSTWPACPPGRSQLNLRGTPSSTVDFPFIGHGL

SEQ ID NO: 785840 - protein, 78 aa, Homo sapiens
CFLPTIRNSKEFRFILVSSASASGYEIHCFQPPFWPVQRGRHHFQIASGGAGNKLESSLVFTWLWFEGLMTVIETLYR

SEQ ID NO: 785841 - protein, 101 aa, Homo sapiens
TSPQSGSSFSCGLCSLRPCCPCVTHAPSCRDRRCCSTLLWLCPVVLLVSFPCVSQVSPISSLPGSYMPPGCYLCTRLHLPWSLMQPAQMRIEGVFVHNPGS

SEQ ID NO: 785842 - protein, 109 aa, Homo sapiens
PAPLCSHGINGSLRPLPCPGTQVGRSLGLRHWEQENGLDQAWLQTAILGLPVRHQPTVCSSPQALGRGPPVVRVPGLEQLHSHTGISVFEPHPCFQSHSEAAPPCCTAQ

SEQ ID NO: 785843 - protein, 101 aa, Homo sapiens
WDYRCPRPRLANFVFLVETFHHVGQTGLKPLTSGDPPTSVSQSAGITIMRHHAQLNFVFLVEMGFCHVGQAGLKLLASSNPSVPFTPNTILVTRTLCFVLY

SEQ ID NO: 785844 - protein, 111 aa, Homo sapiens
MVSTYISRLKPHSSRSLGPGGSRRHWGVGPKSQDHKESGWFAVGPEGSRCHFWGKCGGGARGDALCPAPVQQQHLAGTSPSPDRVCTPTSPARPLGKQEVRSGRPAQGGAA

SEQ ID NO: 785845 - protein, 104 aa, Homo sapiens
PHSTFSVSLFHLRAQCSLGFPFGVEAPSLTKGNEPYGRKPCVFPPSASHSTCGSLSQAASEFSDYPSYRQPQHPCFCFCFCFCFFFFLKQDLTLSPRLKCSGNK

SEQ ID NO: 785846 - protein, 110 aa, Homo sapiens
MTGQSMGKNYPLCPGSRMGKCLMIENYILLKYGFQCDGKYVCPRCWKSLQGEKLCVTAVEVYPSFRGFKTSLWSYESKISAAFSYGEEAWKQAIFQEKKKEWGVLSPVVS

SEQ ID NO: 785847 - protein, 45 aa, Homo sapiens
FLTSTWCESCYRKGFHFSSSSFFCSSFCFCLKALSSSSISLACIL

SEQ ID NO: 785848 - protein, 80 aa, Homo sapiens
KMVLSSGTTMYLGIADRMQKEITALAPSTMKIKIITPPERKYSVWIGGSILASLSTFQQMWISKQEYDESGPSIVHRKCF

SEQ ID NO: 785849 - protein, 80 aa, Homo sapiens; identical to SEQ ID NO: 785848

SEQ ID NO: 785850 - protein, 80 aa, Homo sapiens; identical to SEQ ID NO: 785848

SEQ ID NO: 785851 - protein, 80 aa, Homo sapiens; identical to SEQ ID NO: 785848

SEQ ID NO: 785852 - protein, 89 aa, Homo sapiens
CLPTVLKKVQLLYRSPSFPPPTSPDLFPQEILYSRTGHTKLSIPGTQPGFFYLLTSGKTILKIPYFWMLFLSFSPHLLGHFWASFRFQL

SEQ ID NO: 785853 - protein, 112 aa, Homo sapiens
LIHYSFISSFHLTISFHHLISSFHFIIHLIISSFISSFHIIILSHLSFHLISSHLIPSLHLISSRLGLVLTLIAEMGDYRPTLPHPACVCVCVLVETGDYRHTPPHPACVCV

SEQ ID NO: 785854 - protein, 242 aa, Homo sapiens
SERGSVESWSSRHRRRRGSPGTAAPGRRVRCSRSPTQGDSRPLVRPGQPGTDPPAQARLQPEGWEGIALAASRGGQAEAREQVRGTKSFADVPGVLRAPAAGTRRPGAREEPVDVLRAAWEPPPPPPQREEECTGRAAAGRAPPLLALLAALLLAARGAAAQETELSVSAELVPTSSWNISSELNKDSYLTLDEPMNNITTSLGQTAELHCKVSGNPPPTIRWFKNDAPVVQEPRRLSFRST

SEQ ID NO: 785855 - protein, 102 aa, Homo sapiens
MNNSNEFLTVLLAGSPASAHWQTRCLGRACFPFVDGRQLSRGLCYESTDSIHTGSAPVTSSPPTGPAFSYRHLRAEDFDRNLGGHKHSGLSKCVLFSNYHQF

SEQ ID NO: 785856 - protein, 64 aa, Homo sapiens
DASKAAFTASPSSCFLANRNKGSMVSSDAVKNESHVETTYLPLPSSQPGGLGPALHQFPAGNTD

SEQ ID NO: 785857 - protein, 134 aa, Homo sapiens
PADGRCPAVPAEGLWRHLQQVEQSRSQVQAIGEKVSLAQAKIEKIKGSKKAIKVFSSAKYPAPERLQEYGSIFTGAQDPGLQRRPRHRIQSKHRPLDERALQEKLKDFPVCVSTKPEPEDDAEEGLGGLPSNIS

SEQ ID NO: 785858 - protein, 286 aa, Homo sapiens
AALAARGGRGCRARAGGLLPATQSPAMSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSSMEVFNANIFSTSCLFLKLLGSKLFYCSNGNLSSITSHLQDPNHLTLDWVANVEGLPEEEYTKQNLKRLWVVPANKQINSFQVFVEEVLKIALSDGFCIDSSHPHALDFMNNKIIRLIRYR

SEQ ID NO: 785859 - protein, 285 aa, Homo sapiens
TAKRQHQEPRASSWQGLLPATQSPAMSDPITLNVGGKLYTTSLATLTSFPDSMLGAMFSGKMPTKRDSQGNCFIDRDGKVFRYILNFLRTSHLDLPEDFQEMGLLRREADFYQVQPLIEALQEKEVELSKAEKNAMLNITLNQRVQTVHFTVREAPQIYSLSSSSMEVFNANIFSTSCLFLKLLGSKLFYCSNGNLSSITSHLQDPNHLTLDWVANVEGLPEEEYTKQNLKRLWVVPANKQINSFQVFVEEVLKIALSDGFCIDSSHPHALDFMNNKIIRLIRYR

SEQ ID NO: 785860 - protein, 230 aa, Homo sapiens
GFGFVSHATAEKVDAAMNARPQKVDGRVVEPKRAVSREDSQRPGAHLTVKKIFVGGIKEDTEEHHLRDYFEQYGKNEVIEIMTEAVAKKRGFAFVTFDNHNSMDKTVIQKYHTVNGHNCEVRKALSDQEMARASSSQRGQSSSGNFGGGHGGGFSGNDNFGHGGNFSGHDGFGGSCGGDGYGGSGDGYNGFGNDGGYGGGGPGYSGGSRGYGSVGQGYGSQGSGYGGSGS

SEQ ID NO: 785861 - protein, 35 aa, Homo sapiens
TAQWCRDCPKNRNDSKVAKASKESTIVVKLFLRKE

SEQ ID NO: 785862 - protein, 101 aa, Homo sapiens
GKILLPSFLPRARGLQNSWALGKWLPPWDPNRKMEERDGPREGASPLIWFGSRRLSAQPRGSPFISSGSLQLYHQQWDLLPPEGWAEAVAAADVTGPLPGS

SEQ ID NO: 785863 - protein, 109 aa, Homo sapiens
LYLERKRSTPFGSKESLSMSVIRNPQQRLAGSLKGQGGRSAATTVRRASRKQADLPRTRHQLPEGLSSLPFPLEPPRLILGKFQELPGELQVQFKHNSQGIQVFLPTRR

SEQ ID NO: 785864 - protein, 68 aa, Homo sapiens
LLGSAASAPDSPPASSEPSCCSRSGRAGLSSSPVACTDLLSWASKEEQEGTNIWNLPSRHVFMLFKHL

SEQ ID NO: 785865 - protein, 159 aa, Homo sapiens
MSAAPGLLHQELSCPLCLQLFDAPVTAECGHSFCRACLGRVAGEPAADGTVLCPCCQAPTRPQALSTNLQLARLVEGLAQVPQGHCEEHLDPLSIYCEQDRALVCGVCASLGSHRGHRLLPAAEAHARLKTQLPQQKLQLQEACMRKEKSVAVLEHQLV

SEQ ID NO: 785866 - protein, 47 aa, Homo sapiens
SSSSTGYISSSYSSTDTFHPAPPLRTHFIQLLLYRDISSSSSSTDTF

SEQ ID NO: 785867 - protein, 123 aa, Homo sapiens
LKVEFCPYCSVWNAMARSQLTASSASWVQASLLPQPPYWWCYTAACMCAWLCVYTDFCSHICPCTSPCPHVCTHIHAADKRQLHYGRAWWLTPVIPALWEAEVGRSPESGVQGQPDQHGETLT

SEQ ID NO: 785868 - protein, 74 aa, Homo sapiens
PSTEGTSLTPQHLLAPAPASSPPQQGPPRHFSIFFTCIAVPAQPEPTGPPAPPGQGSTCCVQGQAPLDLPHDLH

SEQ ID NO: 785869 - protein, 106 aa, Homo sapiens
IVCVCVCVCVYVCVCVCVCVCVCVFEHFSSFLECVCVCVSLSISLHSWNEPWTVKLCGKRRLFGDPDMKKSTKWEIFSHLWQSLRILFRYRGFHTPVGGYLGGSKM

SEQ ID NO: 785870 - protein, 50 aa, Homo sapiens
QRDVAVEHELRQRLLVLVEDRVQQLQLGLEPSHGHFILTSGRWGAKVSPS

SEQ ID NO: 785871 - protein, 118 aa, Homo sapiens
MESGRSPPTPATSASPPGPTLKARFRSLLETAWLNGLALPTWGHKFLKTRPALTLPTAAGQPEPSPVALVASAVCIAVTLHPSLLPAQLPRGHEWMLGLWLLPGGSISDLCPFGVVAS

SEQ ID NO: 785872 - protein, 993 aa, Homo sapiens
PAERWVSVSSEEPRAPVPASVRAPERPLPGLRSARRAACRAYSGPRTCPAHLPAARSALRASLASLPATARGLRPCLRVRPAPQPGPGAALRRARAARSPARAGAAMMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPPAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 785873 - protein, 817 aa, Homo sapiens
MDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPPAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 785874 - protein, 75 aa, Homo sapiens
HSDWRTFSCLLFQDNVLNIINQIMDECIPQDRAPRDFCVKFPEEIRHDNLAGQLWFGAEVAGGHPGSEVLMWGGV

SEQ ID NO: 785875 - protein, 120 aa, Homo sapiens
DGPPSPLVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 785876 - protein, 55 aa, Homo sapiens
MIGHPAHSRCAEESSQGELGCSGRGDTQGLAEKPREVTTGGNLKNEDVPTSSRKQ

SEQ ID NO: 785877 - protein, 103 aa, Homo sapiens
VKLPLPVASHYIHKHSLSISYFPVSVLGLEDVRNNPRHGGVLDVGRNRKLNHKPHYNMVKAIIYIRKRCFHPSSAGVYSLYCQTVCVFPDGTNCILCLLFFFP

SEQ ID NO: 785878 - protein, 272 aa, Homo sapiens [sequence omitted]

SEQ ID NO: 785879 - protein, 78 aa, Homo sapiens
MRKEEQEVATLGAALDAVDCIQTPPSDAHHTRARAPPPPPLSDCIQRRNAGAVCSGCSVNAGPVSNRCLVNVGSVCSG

SEQ ID NO: 785880 - protein, 60 aa, Homo sapiens
MSFEGGHGGSRCRGAESGDAEPPPQPPPPPPPTPPPGEPAPVPAAPRYLPPLPASPETPE

SEQ ID NO: 785881 - protein, 128 aa, Homo sapiens
MRAGRNYLSPVATTACAKLYLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAY

SEQ ID NO: 785882 - protein, 139 aa, Homo sapiens
LGRCAFLSPPEAPPAATLSRWPNFHKALPSFPSPTDASPRPAPSSSLPLSTATAHGLQHATSAFWILTVLSLPLTSVVTSWTSLHMLQHLKLISLSSKHPLMFLSVNPLSSYMYCLWLTPIPHHVPAVALGTTFDASGP

SEQ ID NO: 785883 - protein, 207 aa, Homo sapiens
MDGASRRPRQSHSISSSSFGAGAVRARRRGEPRSLPRPGDDRAASSSCAEGLSSLCSDEPSSEIMTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIY

SEQ ID NO: 785884 - protein, 143 aa, Homo sapiens
MTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIY

SEQ ID NO: 785885 - protein, 30 aa, Homo sapiens
MSSLERGVPIKTGSWGLAAQRRSAQERNSS

SEQ ID NO: 785886 - protein, 125 aa, Homo sapiens
MALARCRLHSFFFFYRDEISLCCPGWSRTPGSSDPLASASQGAGITGMSHRSGPRLCSKHLTCISSSYTRNKPHFEVGSIIILILQMRKLRHRDVKWIALAHITEYMVEVELVFEFRATRSAVLY

SEQ ID NO: 785887 - protein, 102 aa, Homo sapiens
LHPPRFQSMLQIAWSPRQRLVTEAEPLQRAPTMAILHKNVGLGLVPELPQRVLTGVMPSGALGAGLALRLQDRGATSMQPQPGRAAGRRLQPMKHGLGLGKP

SEQ ID NO: 785888 - protein, 44 aa, Homo sapiens
MPFTSEGTNAGGGFSSGHKKECHATPMSKGRGSGNAGDVGTTGL

SEQ ID NO: 785889 - protein, 91 aa, Homo sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPG

SEQ ID NO: 785890 - protein, 270 aa, Homo sapiens
QEGLSAEHVDAHPPLSLMEVVTFGDVAVHFSREEWQCLDPGQRALYREVMLENHSSVAVTAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECA

SEQ ID NO: 785891 - protein, 69 aa, Homo sapiens
AGTRVAKARFLAAIARLRASWWSSGRAGFLVFKPELISRLEQGEEPWVLDLQGAEGTEAPRTSKTVLLG

SEQ ID NO: 785892 - protein, 110 aa, Homo sapiens
MDANSPHGHPPTSCCLPKNVAPARVTSSDSSCHSSSGELLHQHCKNGVVSPTSTPQDPKYPFITVANPMTELYLPFSSLNPCECSLPGFSCTTMWEQLSRSSMNSTLPEP

SEQ ID NO: 785893 - protein, 92 aa, Homo sapiens
GKFPGHWGNVSERNGTTFAASHAFDKADLTPTDFCWQKAARAGWVPQCKTATHCKTSPARQKPQLLGHTPSSLAHEAGAPGSCVHARSMLYA

SEQ ID NO: 785894 - protein, 121 aa, Homo sapiens
MSGVRDHSGQHGETLSLLKIQKLARGSGVCLSSQLLGMLQQENHLNQGVGGCEPPRPASCRFNWRNCLIGPSNSTCPRLNSKSPLIPLPPQACSSESSASQECSGQNPWHPACLLLASCLS

SEQ ID NO: 785895 - protein, 114 aa, Homo sapiens
CHIMYILIFMSIICCCILNDKDLKSGNPTSNVPSVPVSGREGASWMHFTPVIRRAMASSSLACPGVIMLSAGCGSGCPSKACSFSFSKSAGAERGGEERLWLAVSGVWKHWHAG

SEQ ID NO: 785896 - protein, 37 aa, Homo sapiens
MAALSLCLRVVFPLFIWVLLSYLHKDTSRIGLGPTVN

SEQ ID NO: 785897 - protein, 127 aa, Homo sapiens
MRQELSPASRRFGRGSERLRSPRIILRVPNYRALGCQRVHSSSQEKGGTFVRGLISGPWGTKWVRLPGERQGGWRIAWCGEERRAMAGRHWSTDGKWQGHKLHHCRQLVEASPGSEANLCSTLQGKT

SEQ ID NO: 785898 - protein, 107 aa, Homo sapiens
GLGAPRTLSGRLAPPALGSERLSTRASSCGGCTGSSNSDGPPAPRSNFRWASATSPPPAPQPRAPARHPEGTGATSCYAASGPVNRPTAEECGSAPETGGQLRPRPG

SEQ ID NO: 785899 - protein, 264 aa, Homo sapiens
ASASRRRHRPVLGPRRSARLLFPALLEACKGRATCPDSPQDRKKRNLDMEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAPRGQRGVRGVTSLEACNHVNGIDFGGEPMFSQAGIKKVFLAP

SEQ ID NO: 785900 - protein, 248 aa, Homo sapiens
ASASRRRHRPVLGPRRSARLLFPALLEACKGRATCPDSPQDRKKRNLDMEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAPRGQRGVRGVRGGGRGQRGLHDIPYL

SEQ ID NO: 785901 - protein, 76 aa, Homo sapiens
IVPAPGASPSGSRPGPSPPFPGAEPAGIAALGSTTVTSVPNAVPSAVLWGAAVPGFPGAPAVCESFSCKCMAARNG

SEQ ID NO: 785902 - protein, 76 aa, Homo sapiens
MALLTTAPRCDIRGQILGWRCADKQVYMLVRQEDKTRAWRGQESGTGGLWDARDPRAAFRRRPVSPEPSLFTSGPA

SEQ ID NO: 785903 - protein, 102 aa, Homo sapiens
SGPQVECSGGGSSGSYKQAKPVFRVCASALQPCRGWTELLSVAAGAGRWLSGSGEHKLRFLMVTAVAVATAAVGRASPQGTCNCTTALPLVGMVVAVSGNSF

SEQ ID NO: 785904 - protein, 111 aa, Homo sapiens
PEHTAPPLKALHSAHCNWNTSVFSCGPAAHASSLTTSGALHLYSYPWAFAQAVPLTWTVLTPYLVWLALPHKTSTQMSSQRGFSRHRPAWHLVPAVPLWRPFCWTFSTAWR

SEQ ID NO: 785905 - protein, 65 aa, Homo sapiens
AGEILSPSSLDTSHLKQCVKCSGPPHTSSLASPWPSGALCTKSHMAAAEFRTLVPSSILYPANLL

SEQ ID NO: 785906 - protein, 41 aa, Homo sapiens
MGGWMNGWMGGGGYEWVDEWTDEWTNGWVGWWVDRWMSGWM

SEQ ID NO: 785907 - protein, 74 aa, Homo sapiens
MTTSQKHRDFVAEPMGEKPVGSLAGIGEVLGKKLEERGFDKAYVVLGQFLVLKKDEDLYREWLKDTCGASAKQS

SEQ ID NO: 785908 - protein, 107 aa, Homo sapiens
SPRLQCSGESSAHCNFHLPGSSDSPASASQVAGITGTCHHAWLIFVFLVVMGFRHVGQAGLELLTSRDPPTLASHSVRITGVSHGTRLYYHLCLDIKWATQAWYVQN

SEQ ID NO: 785909 - protein, 111 aa, Homo sapiens [sequence omitted]

SEQ ID NO: 785910 - protein, 86 aa, Homo sapiens
RRNSLGLIIALDYKREAKGELYWDDGVSKDAVTEKKYILYDFSVTSNHLQAKIINNNYMDTDNLMFTDITILGMDKQPANFIVLLN

SEQ ID NO: 785911 - protein, 112 aa, Homo sapiens
WSPKVSAHPAPEPPAPFLYMASFVARLLHRGLCMPGKAKLAQRATSHLCKGVPGTGGPITNLTCCQSQYISSSALELGPQCHLLFLRTLLHQPSGGSYSCCWNLAIWASLSG

SEQ ID NO: 785912 - protein, 102 aa, Homo sapiens [sequence omitted]

SEQ ID NO: 785913 - protein, 38 aa, Homo sapiens
MLGHGDSTCKGPVAGAQELSGDRARNRDLVRDTSPRPG

SEQ ID NO: 785914 - protein, 34 aa, Homo sapiens
PQPQSLVLNLIFTSILSAESRIWLCECLAGACPA

SEQ ID NO: 785915 - protein, 62 aa, Homo sapiens
RLYTIPLFIDRYERSDETQSKADTDPTISIVTLDVNGVNNPIKSRHRPNYINRNIRCEWSEQ

SEQ ID NO: 785916 - protein, 77 aa, Homo sapiens
MMLGTEGGEGFVVKVRGLPWSCSADEVQRFFSDCKIQNGAQGIRFIYTREGRPSGEAFVELESEDEVKLALKKDRET

SEQ ID NO: 785917 - protein, 48 aa, Homo sapiens
MLVPTAEVTCSTSGTAAALHGVGTCASTWSCLSITAGMPGCAQWPGPT

SEQ ID NO: 785918 - protein, 80 aa, Homo sapiens
SGRSSKNTQIESPCDPAVPLLDIYPKEVTAGPPTVTLHANIHNSIIHNSHKDGCHPSLLWQMTWRNTVWYIHTNGNLIHV

SEQ ID NO: 785919 - protein, 109 aa, Homo sapiens [sequence omitted]

SEQ ID NO: 785920 - protein, 158 aa, Homo sapiens
MTFEDIIVDFTQEEWALLDTSQRKLFQDVMLENISHLVSMANSSANQLCFPNGASREISTQRISLLQGREVGIKHQEIPFIQHIYQKGTSTISTMRSHTQEDPFLCNDLGEDFTQHIDDSKCDYLHENETLLLSKKLGENLQLTGYPLNQPQGNSHQM

SEQ ID NO: 785921 - protein, 176 aa, Homo sapiens
MDICREGVTKAAWMTAGDGGIYLPLPSPPACPRSSPAQVLSFPHSEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDK

SEQ ID NO: 785922 - protein, 309 aa, Homo sapiens
MQSLWEKACENLRNLNMETTRTRCWKDYVSLRIEAIRAEYQKMPAFLHEEEQHHLERLRKEGEDIFQQLNESKARMEHSRELLRGMYEDLKQMCHKADVELLQAFGDILHRYESLLLQVSEPVNPELSAGPITGLLDSLSGFRVDFTLQPERANSHIFLCGDLRSMNVGCDPQDDPDITGKSECFLVWGAQAFTSGKYYWEVHMGDSWNWAFGVCNNYWKEKRQNDKIDGEEGLFLLGCVKEDTHCSLFTTSPLVVQYVPRPTSTVGLFLDCEGRTVSFVDVDQSSLIYTIPNCSFSPPLRPIFCCSHF

SEQ ID NO: 785923 - protein, 112 aa, Homo sapiens
MSEEFTFLVVRWPESLKQTLLVLAEASVPVSTIPVRISLIAFVFFLEEFKVILPLSVCVLEKQSRKLKRTSVLAFWKGLNLKMKPDHVTSLLKALPRVSKVLRVKAHMFNMT

SEQ ID NO: 785924 - protein, 107 aa, Homo sapiens
LSWLLGGTGGETKEASWDHLERFSSFSRVFIYLFFPRHLCGLICPLVAICNTNCSQEGSKNVRAWSKADLNLSPAINNIRVAHACNPSTLGGRGGRIMRSEDRDHPG

SEQ ID NO: 785925 - protein, 144 aa, Homo sapiens
MGARRVSAPQPGSERAAGGARAARAPEMPSCEAPSARPGEIARRQRRRGGPGDDQGAPNKAALGGPEASASLGDRSAKLPVISHRWRWPMACTDGALVGARARLGIGGIGRRLWRTRKRRRWRYSLERNLSLHEAGASSSPEEL

SEQ ID NO: 785926 - protein, 144 aa, Homo sapiens; identical to SEQ ID NO: 785925

SEQ ID NO: 785927 - protein, 79 aa, Homo sapiens
QARQPASQAAKPAKPVKPDSQPRQACQPNQPGSQASQASQPAKPGMPAKPSSQLSQPASQASQATRPAKPAKPAKPANQ

SEQ ID NO: 785928 - protein, 70 aa, Homo sapiens
MGFRLLFAAEASTHVSRQSRQNRECGGSDLQLHHPELGSPKGPDRQTSIYWVQGHGQREHKHVTLLARGG

SEQ ID NO: 785929 - protein, 115 aa, Homo sapiens
GCEVVEDSGLQVGTVLVSLSLSDIPDAPRAWLGQLPSWAWFSQTQSQKPCCQHLVQPQAYTTSVPHQWGALCLVVPASLRPGVQRASLSHRCCSPRDPGQSTTQPPRLPAIHLLY

SEQ ID NO: 785930 - protein, 60 aa, Homo sapiens
SEGKVLGRSPCPSGNACGRGTRMLLTAATNAPCTVLDVGVAAAPVRFPIYTQLPPLVLLL

SEQ ID NO: 785931 - protein, 51 aa, Homo sapiens
PRQSQSSNTISNSPTLNLPLLLLAFLTSIPGSNPTELLSVPTAIYVRSLTN

SEQ ID NO: 785932 - protein, 36 aa, Homo sapiens
MRKPALLIPTNIIHHEERQKETFVVSSSKTKQKDSN

SEQ ID NO: 785933 - protein, 69 aa, Homo sapiens
WGFTSLAFLSSSWLLGQALTCTRPSAELSVSKISLHPYNLLERSYSVLSAILVRNFRTAVSSSRKRRLE

SEQ ID NO: 785934 - protein, 63 aa, Homo sapiens
MTASMTFLKYTSDQAWPLLPTAPWCLKDHRLKPKSLHLAFKALLTQAHLALPADSLTLLLLQP

SEQ ID NO: 785935 - protein, 220 aa, Homo sapiens
AIQIHRSTGLHLAQGSAMPILPANLLVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSLPTFHYEVVQAPRKGNLQLQGTRLSDGQGFTQDDVQAGRVTYGAMARASEAVKDTFCFHVTAPP

SEQ ID NO: 785936 - protein, 126 aa, Homo sapiens
MLTTHSVFRTGLLSLGLCNVYAWTESLPMGCCTLVRFRCYSPPPLLALCSVVFGLAVLYCVEVAFLFVQLPTTIHVFVGAQKTTPLGMLSASNQRRWEGFRSSLGSKVFLWPSPALLSPAPLSPPE

SEQ ID NO: 785937 - protein, 84 aa, Homo sapiens
VFRGSPVLFLHFPALSGNIDFRCYKIAVEEFWLQNIQGIRIGDEMGPSLDLVLRRTHLVLDDLYNLSMIMPEVLKLSRKNNISH

SEQ ID NO: 785938 - protein, 407 aa, Homo sapiens
MKLDGLRVHRGQLGVCWGVWVSSGSRNRGQRHPVLRWGEGSALGSRGSGLGHGGVGSGRFLPEERSWAGRADGLGRIAGPVLISSIKLHFMEPAPRSCSNASATADHGPAAPARPEDMRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 785939 - protein, 188 aa, Homo sapiens
MYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 785940 - protein, 74 aa, Homo sapiens
VVSQQDMSSHRVFSIQWPAPQGHGCGPHYFCLVFCWAGAGVTVEGQGSGTLGWQGSGILLAGDTFQPARLGGQK

SEQ ID NO: 785941 - protein, 131 aa, Homo sapiens
MPALVLVAIAAALGGLLRPAEPGIPSASTCPAPSPWWGWERGNGPSILNRLKAPPSHIRGRESSHLLDLAWPRGRPSPDCQSLLDGLPDHEGTGQAAWAPHSPLPARRSMPALPSIGKDVWSHGNGLCSGA

SEQ ID NO: 785942 - protein, 101 aa, Homo sapiens
HHKLLLIVNILAKLFGTQPLHHVNNCKFLLPFTEVYSWFWFFVFCVSFGIFIIPKLSGFPENVVLPSAGSYDNDNLKMSPMTFRLLDYKHCLEILFNVSIC

SEQ ID NO: 785943 - protein, 65 aa, Homo sapiens
MSSNMASIAMVPASVQLSKAYAVPSEFVPLLYHRMVSLGDSLYFQVCIVQGIHKELYGIAFPSFS

SEQ ID NO: 785944 - protein, 83 aa, Homo sapiens
DLFYHKSLFTYPIYIIVQVQWKTNYTELRQTNQYLTTDHRVKDQVSSITDNNKTVLVPTNFPHNEVVTMELGLRTLHCIFLFL

SEQ ID NO: 785945 - protein, 129 aa, Homo sapiens
GVEGRKGRAEELGSPERKAASLPGGNTWRGTGVAQSPTRATPSGCLWLRTLMGAAPTVLLLLGESRAEQDSSRESGMRGVSHISAHSKGEAQSFYTPVMACRELGLPSRAGGAGLFVFETGSHSVTQAG

SEQ ID NO: 785946 - protein, 121 aa, Homo sapiens
TLELTVNRSTSDVSSNIMLPNFFRSYFLKKLNGHPRPSFLCAPPATTCPATWPDTYAKTSPVKANYYTQLTNNLTNGTSYPRDNSADPILESISTIGFTTSMLDQDIPMVQPLLKVRLFND

SEQ ID NO: 785947 - protein, 102 aa, Homo sapiens
MMLAIALVMTAAPALPITSFNPRHKPASSVGSHFRKETKAQRWQGKELSPGLASNSCFLTLTAASGPGSCSKSDTPHSFLSQSQAWCHNNSWPVGRLKTKGI

SEQ ID NO: 785948 - protein, 227 aa, Homo sapiens
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 785949 - protein, 227 aa, Homo sapiens; identical to SEQ ID NO: 785948

SEQ ID NO: 785950 - protein, 161 aa, Homo sapiens [sequence omitted]

SEQ ID NO: 785951 - protein, 243 aa, Homo sapiens
MLLSLLGACAVVGPFHGPEWEPVQGLLSQNHSCRDPQCCGNLLVLCLFLVWQVRHCWHQVTRTRFSTRNVIKVPLQKRAVPSMRCETVFKLTPEFFSPGKSRGLDSQQCAQRQRWGYRRSLQESWAQNLLSPQHPCPGPPSGVHTHSEPIFCTTSISNTCLLPQNSSWKAWQVPWCLHDGQTRPALDMCQEMEQLLLHSQERLVSLEPVISVRSRPTSMTLTTSLPNLLSAERLQFCPQRAPA

SEQ ID NO: 785952 - protein, 152 aa, Homo sapiens
MWKQLWNWVTGRGWNSFENSEEDRKMWESLELPRVLLNGFAQNADSNLDNKIQVEVISDGDEEPVGNWGKGDSCYVLGKRLVAFCLCPRDLWNFELERDDLGYMVEEISKQKSIQKVTWELLKAFHFKRETENNNSENLPPDNGVEKKHPFF

SEQ ID NO: 785953 - protein, 217 aa, Homo sapiens
TACPCVLQPSAGPAEQQQRTLLTARQPPPPAVALLSRWSVRPAHVTMGKSRTKRFKRPQFSPTGDCQAEAAAAANGTGGEEDDGPAAELLEKLQHPSAEVRECACAGLARLVQQRPALPGLARRDAVRRLGPLLLDPSLAVRETAAGALRNLSACGGFEVCDDMVTKDIMTPLVALLKECSAGLDSNEMSLQEKTDQNRNSIENIANETVNVLWEYM

SEQ ID NO: 785954 - protein, 248 aa, Homo sapiens
SPNGSSSLSPERQANGDLPPVPSASDFQPLRYLDGVPSSFQFFLPLGSGGALHLPASSFLTPPKDKCLSPDLPLPKQLVCRWAKCNQLFELLQDLVDHVNDYHVKPEKDAGYCCHWEGCARHGRGFNARYKMLIHIRTHTNEKPHRCPTCSKSFSRLENLKIHNRSHTGEKPYVCPYEGCNKRYSNSSDRFKHTRTHYVDKPYYCKMPGCHKRYTDPSSLRKHIKAHGHFVSHEQQELLQLRPPPKPP

SEQ ID NO: 785955 - protein, 71 aa, Homo sapiens
AYSSLGQEEAFYLITERQMSMWRSTAFLFSFLLRVCVLCLQGQPAGGSWTCQGDRAAGKAWSRRLILVQHC

SEQ ID NO: 785956 - protein, 111 aa, Homo sapiens
MLGPGPQWELTQTGPEPSCPINLKPFLSRSTWVRSTCQVDLTKLAQGEYIAPEKIENIYNRSQPVLQIFVHGESLRSSLVGVVVPDTDVLPSFAAKLGVKGSFEDCAETKF

SEQ ID NO: 785957 - protein, 243 aa, Homo sapiens
PELKGRRGSGMRKNEFGLRRLIPYWKTGIVDIYRAGLRTRWELEDVREGDPDFSKEGEWSKMASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLRPAHIKADFNLADYECEEDPFDNLAVKTYDEKDELRH

SEQ ID NO: 785958 - protein, 88 aa, Homo sapiens
GTRGAHPTASGERNRGGGARSRGETLHRPGTAKHTSCELLKGRHMDTRTLKPRAWHSHREWGVEGELGTCGVDLVLPEAMRLGRKGGD

SEQ ID NO: 785959 - protein, 87 aa, Homo sapiens
PELKGRRGSGMRKNEFGLRRLIPYWKTGIVDIYRAGLRTRWELEDVREGDPDFSKEGEWWGVEGELGTCGVDLVLPEAMRLGRKGGD

SEQ ID NO: 785960 - protein, 55 aa, Homo sapiens
FCHSPPPPKSISGLERAYQPHRGFSQDPCATFPWPGSHVRSLPSCSLLMPLSPFV

SEQ ID NO: 785961 - protein, 123 aa, Homo sapiens
ARAGRWGTGGESRSNEMQTRTQRLAQLFAVRQGGGDEAESPASSRLGAAEEGAAPDKAGSFEGLRRLKLAPQPPIPQVGARGTRSPDPGHHGQPAEGLRGVSGPCRSCPASHTPGHTGPISTH

SEQ ID NO: 785962 - protein, 119 aa, Homo sapiens
MRCVTAANQVFFSEAVLTAANECVGVLLGSLDPSMTIHCDMVITYGLDQLENCQTCGTDYIISVLNLLMLMWALSPTVFALLSKNLMIVHSDLAVHFPTIQYAVLYTLYSHCTRYCIHK

SEQ ID NO: 785963 - protein, 38 aa, Homo sapiens
DPTISIVTLDVNGVNNPIKSRHRPNYINRTIRCEWSEQ

SEQ ID NO: 785964 - protein, 80 aa, Homo sapiens
RLEDTAMRRRLNKHEENLKTKKQEAAEAGSLPASAPASANPDSYTQVLVKEVEQRKLVHSHQGQLTHLAISTHTEHKYAL

SEQ ID NO: 785965 - protein, 425 aa, Homo sapiens
EINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 785966 - protein, 168 aa, Homo sapiens
EINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGKFLNLRFVELN

SEQ ID NO: 785967 - protein, 250 aa, Homo sapiens [sequence omitted]

SEQ ID NO: 785968 - protein, 480 aa, Homo sapiens
MSKEAVTFKDVAVVFTEEELGLLDLAQRKLYRDVMLENFRNLLSVGHQPFHRDTFHFLREEKFWMMDIATQREGNSGGKIQPEMKTFPEAGPHEGWSCQQIWEEIASDLTRPQDSTIKSSQFFEQGDAHSQVEEGISIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEKHYNCEACGRAFIHDFQLQKHQRIHTGEKPFKCEICGVSFRLRSSLNRHCVVHTGEKLYKSEKYGRGFIDRLDLHKHQMIHMGQKPYNCKECGKSFKWSSYLLVHQRVHTGEKPYKCDKCGKSYITKSGLDLHHRAHTGERPYNCDDCGKSFRQASSILNHKRLHCRKKPFKCEDCGKKLVYRSYRKDQQKNHSGENPSKCEDCGKRYKRRLNLDIILSLFLNDT

SEQ ID NO: 785969 - protein, 397 aa, Homo sapiens
MKTFPEAGPHEGWSCQQIWEEIASDLTRPQDSTIKSSQFFEQGDAHSQVEEGISIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEKHYNCEACGRAFIHDFQLQKHQRIHTGEKPFKCEICGVSFRLRSSLNRHCVVHTGEKLYKSEKYGRGFIDRLDLHKHQMIHMGQKPYNCKECGKSFKWSSYLLVHQRVHTGEKPYKCDKCGKSYITKSGLDLHHRAHTGERPYNCDDCGKSFRQASSILNHKRLHCRKKPFKCEDCGKKLVYRSYRKDQQKNHSGENPSKCEDCGKRYKRRLNLDIILSLFLNDT

SEQ ID NO: 785970 - protein, 480 aa, Homo sapiens; identical to SEQ ID NO: 785968

SEQ ID NO: 785971 - protein, 75 aa, Homo sapiens
ELFGGLFTQTRVKFGAVTRIGGPPLGDQSAPSSCSLLHEKDPPTTSGPQTDQPKKHLTNLNQHPKSENTESKVLQ

SEQ ID NO: 785972 - protein, 35 aa, Homo sapiens
MLVVDVEHLYLVSLWASWHFLHMWYLDSGHDHPER

SEQ ID NO: 785973 - protein, 123 aa, Homo sapiens
SLVTCPICHAPYVEEDLLIQCRHCERWMHAGCESLFTEDDVEQAADEGFDCVSCQPYVVKPVAPVAPPELVPMKVKEPEPQYFRFEGVWLTDTGMALLRNLTMSPSAQAAPTGEDGLASPGDG

SEQ ID NO: 785974 - protein, 72 aa, Homo sapiens
SLVTCPICHAPYVEEDLLIQCRHCERWMHAGCESLFTEDDVEQAADEGFDCVSCQPYVVKPVGEYQLLGRGR

SEQ ID NO: 785975 - protein, 115 aa, Homo sapiens
METNTIGNTHTPQISNSEDRDKTRETNLGTEMMCSQYGRESLAPWPTTVAHTSEMLPGTPSRSLRGTHHLTRNTHMWDLATDWVDLGRLTHSQTWSGQTVTPSAERHRQATVGHS

SEQ ID NO: 785976 - protein, 83 aa, Homo sapiens
AGAPRRGGGSELRRPEAARAEPRDARTNWPDEPPGDGDADQALQLPDGVRGGHPGRGALAARELAAMGKQASFSGSVEVIEMS

SEQ ID NO: 785977 - protein, 196 aa, Homo sapiens
MAGPDEDNLMTVYRDGGRVPGSHGGAPRALSSPGRAGRPGKEQGPSAQGCGQPVGAVCRTPGTKAAVSSLAPASSQGHPWLHSARELGHRDPTGFPGGCQGLRWGRGVSPLGSLHLPKPMCPACPNQSGPPRCWGGTETHEGPSPHSWTWVLWLLAKIATYTPSFPLSWDSWCEPGHQGGRDRPSSGGKVTVSRGF

SEQ ID NO: 785978 - protein, 108 aa, Homo sapiens
PPLAEDQADVSPEELDPRPWVLSAPLPAPGFILPAFRSVRMGLPGGYRVTLRNARLWQRKGWRLQPVARERILGLAYLSQEAGVWRGTEAQGPWGTQLICSRLLTMPG

SEQ ID NO: 785979 - protein, 102 aa, Homo sapiens
SLQPVLADHIPGDSSDAEEQLHKKQRLNLVSSSSDGTCVAARTRPVLSCKKRRLVRPNSIVPLSKKVHRNSTIRPGCDVNPSCALCGSGSIQHLRFGRYRLI

SEQ ID NO: 785980 - protein, 95 aa, Homo sapiens
LADPKEADGEAELEQEAEQEVVLGLLGNGLEVFPRCHRHDGAMGGLPQQRDAEQRVAKAGQPQDVGGTQEWRQLDQARKELDQERSQEPQFNSGK

SEQ ID NO: 785981 - protein, 88 aa, Homo sapiens
FTAYLSFHSPGQHRSREETPEGRPEKPSRAVGPGRCAASADGPQGQSPREPEQEMRVSALGQVLCTGSGWGPEAANPSSLTNRVGDSP

SEQ ID NO: 785982 - protein, 59 aa, Homo sapiens
KILHSKQFGNILIVSGDVNLAESDLAYTRAIMGSGEEDYTGKDVLILGGGDGGILCEIV

SEQ ID NO: 785983 - protein, 114 aa, Homo sapiens
RLAWAWRRRALDPPDVDRRDRCRTLTIDDAFIAAGERLRLQDPADDPALPRRFICSFPDCSANYMQSLEADAHLCKHTGERPFVCDYEGCGKAFIRDYHLSRHILTHTGEKPFV

SEQ ID NO: 785984 - protein, 127 aa, Homo sapiens
MYTYVCIYTYVCIHMCVYIRMYVYICVYIYVCMYTYVCIYTYVCIHICVYIRVYVYIYVYIYVCMYTYMCIYTCVCIHICVYIRVYVYIYVYIYVCMYTYVCIYTCVYIYTYIRIYVYIYTQLNQWD

SEQ ID NO: 785985 - protein, 126 aa, Homo sapiens
SKGSLEITESQSADAEPPPPPKPDLSRYTGLRTHLGLATNEDSSLLAKDSPPTPTMYKYRPGYSSSSTSAAMPHSSSAKMSRGDSLKEPTSIAESSRHLSYRSEPSIGTQRASVLLPLAECFHYDA

SEQ ID NO: 785986 - protein, 102 aa, Homo sapiens
AGSAGAALGVENPGCTVPLTIVHRPPRPVWGHVGWALTPGRAAGSTSARGSSMQRWARTGVSDRCGYFFEFSGTVKSSQPTPQSTWSPLLLPAAQCSGHCVS

SEQ ID NO: 785987 - protein, 136 aa, Homo sapiens
CSPSSRDAVGEAESQPPAHPPTCRSASISSLAAFFSDVLLLSLDSASSTSVCSLSSSEMTWSRSLMMSLYSLYTASRSSLYFSDSFAVFTCVVLSSVSSDCSSSISHCRSLFCAVALFSSWWIASNLAREVARCGK

SEQ ID NO: 785988 - protein, 130 aa, Homo sapiens
APAQSTVDATTAQCCLGMRAGEPPLSPAMPSPPGSRCLLTLSRFCLLLRNEVEVGIRKEEMQEGQASPLSYHAGSSFFCSRRFPHSGRMGGPKNEANCLSPSAPKSSQPLTCPGRAWAQPDQEGCLRFAP

SEQ ID NO: 785989 - protein, 109 aa, Homo sapiens
LLHSFYIIPQCSVLPPPKDKTKIDIVEVNDLKQTLAIETGYQDANAWMEWIKYSVHTLNKSNCYACAHSRPEAQIVPFPLRWSSRRPSMGCMVALFQDSTAWGNISCQA

SEQ ID NO: 785990 - protein, 45 aa, Homo sapiens
SEDGVTRLVPMTVIRPWGVDMESNSVLEAKNEVVCIVEIVPGDLA

SEQ ID NO: 785991 - protein, 132 aa, Homo sapiens
CRRTTQAGTGVMRLQAEEHQRLLVTPDTTKRQGRILPYRFQRKHDTANTLILNFWPPNCETIHFFFFFGDRVSLCHPGWECSDVTSAHCNLHLPGSSDSPASASRGAGITGTRHYAQLILVFLVEMGFHYVS

SEQ ID NO: 785992 - protein, 125 aa, Homo sapiens
RLRQENHLKLGSRGCSELRLCHCTPAWAAEQDSVSTTTTTKAATGRARCRKMINGEKSFSSELGDTVPSLTTPQSLKTIQHNTGSNEDVYSIGWGWERRQSLHQECDATHLQDGKCGEKNCRQKE

SEQ ID NO: 785993 - protein, 339 aa, Homo sapiens
AASDAPKNLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSKSNWESRDEEFIWNHPQKNEFWTYVFGVGKNDSPKLLENISLPAAPEVQNGSPMSQTETVSRSVAPMKRLEDSLHTGSDHTANFCDVTEAGSNPRGKLGGQPTTE

SEQ ID NO: 785994 - protein, 136 aa, Homo sapiens
SSNRRFLSLSFELRQSLTLSSRPDGVQWHDLGSLQPLPPGFKQFSCLSLLSSWDHRHACHHTQLISVFLVEMGSHHVGQAGLKLLTSCNPSASASKKCWDYRHEPPCPAHNCLFRKLTLLLHSTSGDKNYKEISRA

SEQ ID NO: 785995 - protein, 128 aa, Homo sapiens
LHGTGFPEKRRPCLPRLRHHPKVWNSQGSLSRASEIDWGWISLAQLAMQTFLESGLQGDKGELLAWLPAAAFLLSHPLGQESVSDKAAALTRGPSPVDSKAADPHPWRELSQRLRTHSEDTTVCSQVL

SEQ ID NO: 785996 - protein, 99 aa, Homo sapiens
TPFSLQSITVQPPDPSLKISPLNPSMAARLVWETALNLTPIALLGCLAINFLTAKTQCFGVWLSIACVQTDTVWFGHNVLVIFSTLFFALSHILTLYFP

SEQ ID NO: 785997 - protein, 185 aa, Homo sapiens [sequence omitted]

SEQ ID NO: 785998 - protein, 106 aa, Homo sapiens
TVPGRFTQSYIQPYHEDHGHTVTIAPVLILDLRFGGTQDNLLGIYFTFRGIWSSLRVAFLKMSSSGIRGEVLGAYKLRSAFFWEMEPEVNLGAGVSSSANQLHDFG

SEQ ID NO: 785999 - protein, 417 aa, Homo sapiens
KAGVLDTGGEWGDMSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786000 - protein, 380 aa, Homo sapiens
MASACPGSDFTSIHSEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786001 - protein, 334 aa, Homo sapiens
MASACPGSDFTSIHSEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786002 - protein, 297 aa, Homo sapiens
MASACPGSDFTSIHSEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQLQAVLEQRRAQQRWGGRLRGI

SEQ ID NO: 786003 - protein, 404 aa, Homo sapiens
MASACPGSDFTSIHSEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786004 - protein, 373 aa, Homo sapiens
KAGVLDTGGEWGDMSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786005 - protein, 281 aa, Homo sapiens
KAGVLDTGGEWGDMSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786006 - protein, 326 aa, Homo sapiens
KAGVLDTGGEWGDMSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQPEVTASPGWDFQI

SEQ ID NO: 786007 - protein, 393 aa, Homo sapiens
KAGVLDTGGEWGDMSDSKEPRLQQLGLLEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786008 - protein, 325 aa, Homo sapiens
KAGVLDTGGEWGDMSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 786009 - protein, 88 aa, Homo sapiens
KAGVLDTGGEWGDMSDSKEPRLQQLGLLEEEQLRGLGFRQTRGYKSLAGCLGHGPLVLQLLSFTLLAGLLVQVSKVPSSISQEQSSQK

SEQ ID NO: 786010 - protein, 73 aa, Homo sapiens
GAWRAGYWGQRGAVWTVLVIGPGVTRKKSRVTWELKDHLPPKSGRPLKNKLLAYLEGFLPEEHSALWHFVLKL

SEQ ID NO: 786011 - protein, 157 aa, Homo sapiens
SCTEAFFLGLRVKCLPSVAAASIRCSSRPSRDSDRLQLHTDGILSFLKNNKPGDALCVLGLTLSDLYPHEAWSFTFSKFFQGTVTCHELCHLLGLGNCRWLRCLMQGALSLDEALRRPLDLCPICLRKLQHVLGFRLIERYQRLYTWTQAVVGTWPS

SEQ ID NO: 786012 - protein, 92 aa, Homo sapiens
MGEARFWLGEMPLAAKAPGGQAECWPRWAHRAEKGVGLQEEAPGPPEQSRVAVRAGTGDPSAPGCAKERVCGWRAAMRTTMRPRPGPGCTGG

SEQ ID NO: 786013 - protein, 62 aa, Homo sapiens
TTGATETSRTEVASSRRTSIPGPDHSTESPDISTEVIPSLPISLGITESSNMTIITRTGPPL

SEQ ID NO: 786014 - protein, 461 aa, Homo sapiens
MSSSHPEPGPWAPLSPRLQPLSQSSSSLLGEGREQRPELHKTASSTMWQAQLGEASTRPQAPEEEGNPPESMKPARASGPKARPSAGGHWRSSTVGNVSTMGGGDLCRLRAPSAAAMQRSHSDLVRSTQMRGHSGARKASLSCSALGSSPVHRAQLQPGGTSGQGGQALQAWKGTWLLRMRLLNSAWMLGASQLSVPPLDLGDTTAHSSSAQAEPKAAEQLATTTCHALPPAALLCGMREMREVGAGGCCHALPATGILAFPKLVASVSESGLQAQHGVKIHCRLSGGLPGHSHCCAHLWGPAGLVPEPGSRTKDVWTMTSANDLAPAEASPLSAQDAGVQAAPVAACKAVATSPSLEAPAALHVFPEVTLGSSLEEAPSPVRDVRWDAEGMTWEVYGAAVDPEVLGVAIQKHLEMQFEQLQRAPASEDSLSVEGRRGPLRAVMQSLRRPSCCGCSGAAPE

SEQ ID NO: 786015 - protein, 461 aa, Homo sapiens
MSSSHPEPGPWAPLSPRLQPLSQSSSSLLGEGREQRPELHKTASSTMWQAQLGEASTRPQAPEEEGNPPESMKPARASGPKARPSAGGHWRSSTVGNVSTMGGGDLCRLRAPSAAAMQRSHSDLVRSTQMRGHSGARKASLSCSALGSSPVHRAQLQPGGTSGQGGQALQAWKGTWLLRMRLLNSAWMLGASQLSVPPLDLGDTTAHSSSAQAEPKAAEQLANHHLPCSAPAALLCGMREMREVGAGGCCHALPATGILAFPKLVASVSESGLQAQHGVKIHCRLSGGLPGHSHCCAHLWGPAGLVPEPGSRTKDVWTMTSANDLAPAEASPLSAQDAGVQAAPVAACKAVATSPSLEAPAALHVFPEVTLGSSLEEAPSPVRDVRWDAEGMTWEVYGAAVDPEVLGVAIQKHLEMQFEQLQRAPASEDSLSVEGRRGPLRAVMQSLRRPSCCGCSGAAPE

SEQ ID NO: 786016 - protein, 133 aa, Homo sapiens [sequence omitted]

SEQ ID NO: 786017 - protein, 124 aa, Homo sapiens
MPSAWPGFPGISRPDPPLSPLFLCLSAPEEIAVYKNKPAFLVLLLFVIVPSLDWVQSAHLFCQGPVCRSQPKPVVLPGSLCSWKALSRTARGHFGCILSPPSPYVWEQKLALVRYVDVNLSSFL

SEQ ID NO: 786018 - protein, 132 aa, Homo sapiens
MAEPSYTGPAVPYSREIKQKYELTLQERTIKETGDIPNRLEDDTFTEVHIWKSPIGELCPERTMSKARRGGFDPRQADIGGDRNASQRQDGTLLALVLHRQTLKPKRRRELLPIEEARHMALVSPVEHPRRN

SEQ ID NO: 786019 - protein, 103 aa, Homo sapiens
LQVIIQAICSLSSDSIFSLSPKFHATHSISIQIGLPSWDGKKTTLNPTSSSNNHFTYLHPSLLDFTANSLRDFYIAISNFSPPIPAFLNPLQLSFHFHPPPLH

SEQ ID NO: 786020 - protein, 112 aa, Homo sapiens
MEAYEQVQKGPLKLKGVAELGVTKRKKKKKDKDKAKLLEAMGTSKKNEEEKRRGLDKRTPAQAAFEKMQEKRQMERILKKASKTHKQRVEDFNRHLDTLTEHYDIPKVSWTK

SEQ ID NO: 786021 - protein, 114 aa, Homo sapiens
PVQVYTVTPRCPPPTLGPHVLTKFENLYISPIHSVVIISDTLFGGGPSVLPRPSQDLGKSAQGYIRSACQVGSNSTSMQAWMRILFPSAPHSWLEPSVEIGRSNSTPTIPSQEY

SEQ ID NO: 786022 - protein, 114 aa, Homo sapiens; identical to SEQ ID NO: 786021

SEQ ID NO: 786023 - protein, 67 aa, Homo sapiens
ISAARTLWSKGPLFVGFFPPIRPSCSPAVQNQHAACSTCNSSREFNTLALSVQHNVFNWFCSNIKFL

SEQ ID NO: 786024 - protein, 102 aa, Homo sapiens
MGLPRRELLMGFCSDPNEVMLLALELRFRGCSGRCALSRYQELCLANVHKRLGWTLVYIYFLQHFSSIHPEVKDKTKALKTSNEDTLAGNGTFSASRALSRR

SEQ ID NO: 786025 - protein, 158 aa, Homo sapiens
GAIVAPAGCAGPRTLREARVRGHEFEANLVHMGEKKKKNKKKKHSGGPRPGPLEEGFRNPMRWGAAGPQRGKGTRGPKEGPTEGDTRGARGTRPGGVFSTNIKKTPGGGHTRRRLVWTPHSQRGGRCEGPHEGGGLLQQGGLHRQKPGIFKISPQGGG

SEQ ID NO: 786026 - protein, 101 aa, Homo sapiens [sequence omitted]

SEQ ID NO: 786027 - protein, 138 aa, Homo sapiens
GRKPRSSASMSTIYPTALPQKDRQNLSRQVMANSWGENSRLEEMRECLELMNGGAGWASACGHSHGCVCMGVCARVSLCGLCLWPVCMCPLLLRHPLPFPSGQLVSLPSESHSLSCSSPGHPSSQQPCLILFIHKSSC

SEQ ID NO: 786028 - protein, 188 aa, Homo sapiens
MTDLRTTLDRCSQNYHQDSEAAINRQINLELYASYVIPVPCHYYFDRDDVALKNFAKYLSLHQSHEEREHAGGNLMKLAEPTRWPNLTFSDLKNPRLCMHWESGLNAHGVCTNIWQKTVSQITNWKLHNWHLTNVAPMCGDFLRHINWNEPVEGHPRLGDPVTIAARWKRRIWLADILDKTPGNCYEA

SEQ ID NO: 786029 - protein, 120 aa, Homo sapiens
YRVTKQLSAERGTRVGCTTLTQNQVVLPVPEGGQSLQVWLSPGPFFFLGWSLALSPRLECSGAISAHCKLRLAGSCYSPASASPAAGTTGACCHAWLILVFLVETGFHRVSQDGLNLLTL

SEQ ID NO: 786030 - protein, 61 aa, Homo sapiens
PPTAWGMNASHAQHPALHRGSQAGPRLVAKSPFATEWCLQKQGEDVGHKVGPVPGVRTLPR

SEQ ID NO: 786031 - protein, 40 aa, Homo sapiens
ARLGNTEDPISAKTLKNEPRVMVRPVHLCGQGQRVAIVDR

SEQ ID NO: 786032 - protein, 137 aa, Homo sapiens
IQDIGVGKDFMSKTSKAMATKDKIDKWDLIKLKSFCTAKETTITVNRQPTTWEKIFATYSSDKGLISRIYNELKQIYKKKTNNPIKKWVRDMNRHFSKEDIYAAKKHMKKCSSSLAIRELQIKTIYEMISHCDVPHS

SEQ ID NO: 786033 - protein, 228 aa, Homo sapiens
RFLLQIKSGAEAKKLPGVGTKIAGKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGE

SEQ ID NO: 786034 - protein, 213 aa, Homo sapiens
GSQLDSCPVKGHLNGTESLLDLIWDVMTILKLKNADLRKNEDKLNHHQRIGLKYFGDFEKRIPREEMLQMQDIVLNEVKKVDSEYIATVCGSFRRGAESSGDMDVLLTHPSFTSESTKQGVCQLPSKNDEKEYPHRRIDIRLIPKDQYYCGVLYFTGSDIFNKEYEGFHALEKGFHKSSEYTIRPLGESLELQEKPLASGVVDKDIFDYIPVG

SEQ ID NO: 786035 - protein, 68 aa, Homo sapiens
WRRWFLCSAVSSSQSGTCKEMGTEGGRHCSLLKTTDSNARDRGGQWLRQEMFQVERSKSDERQGKNAG

SEQ ID NO: 786036 - protein, 46 aa, Homo sapiens
LILPAAHDKNPVVIFFFHLFFFYPIFNVAANPSGSIFHTDTDSDSL

SEQ ID NO: 786037 - protein, 179 aa, Homo sapiens [sequence omitted]

SEQ ID NO: 786038 - protein, 82 aa, Homo sapiens
HEVLKAGAKPDRLGFITPYEGRRSYLVQLHVSFSVLPGHQALPGGGDCQCGRRFRDAEKDLIILSGVRANEHLRAEVVRSLE

SEQ ID NO: 786039 - protein, 105 aa, Homo sapiens
PLNSESGSYLILAWGTAEEFGLPELGRKTFFFFFGDGVSVARLKCSGVISAHGNLCLLGSSNSPASASRVAGITGAYHHKQLIFCILVETGFHHVVQDGLYLLTT

SEQ ID NO: 786040 - protein, 105 aa, Homo sapiens
MFHLKITQNEESIDFFLTSNFERRKLANTSFTVVSRIAFLIPPLLHILLGLCFLLSLIMTPSPPFPPFSEFSFMASQIHCPFASLLWFQLLSRPFCFIFFLCSHT

SEQ ID NO: 786041 - protein, 159 aa, Homo sapiens
MGEALHKKKRDDDPRCQNNAREGKKLAHQWGILLGRDTPFPRGGATMMGKKSPAENINGREAENPTPSGGWFDGRVPTHRAANERQAAETKQSAAPPKKRASGKNKFYTPAGPRARKKHHARNRPTARYPEPVTTSTLSAGAEPTTPQTDNCQHDGRHR

SEQ ID NO: 786042 - protein, 102 aa, Homo sapiens [sequence omitted]

SEQ ID NO: 786043 - protein, 63 aa, Homo sapiens
MVLNDHSSQVPHGGLSPSMPGLGPAILVSATAVDTAIWSPQRDGAGLPSRSCQGPRRRELLGK

SEQ ID NO: 786044 - protein, 135 aa, Homo sapiens
FVIYLLFVNKYSLLNLVLSLKLVCFFLKSIPTKAGFAASQKERFLCLPRDVREKETRLAWKTFRRAPGRSRSSFENMHRQANSILGRSLEEKVQTWLERHFLPKNKTKQNNNKKNHPITDNWLIQFGCVPTQISS

SEQ ID NO: 786045 - protein, 105 aa, Homo sapiens [sequence omitted]

SEQ ID NO: 786046 - protein, 114 aa, Homo sapiens
MSEELALGQTEEPGPQGLFSEEAQERLRKRGNNPPAGEEGETSHWQVQVQPLPEAAGWGRTSRSFPVDHLPGHIAPQKRLWEGLSGSWQLCPLALTWPLRVFLGPSLCPWPSSS

SEQ ID NO: 786047 - protein, 274 aa, Homo sapiens
VTLSRDAVIHGGGGGGRGRDKHGSGEVLNSVLLSCLSLGTFSPLGSVLDFAGCENLLTSESSVEPRLGLWSAYFLQSDCSCLRWSLSVPLWGTSALISALTAAVRAAGKWGAPSGGRVAVSLLISSVTFKLSLEATAAAGHVRRALGCWGKISSAGSRDRAGGRRGTAPRPRLGTWEGRAGALGPGARPSWDTREDGGGEEVGSAAGELGIMQMGKENLRPRPSAKSSLGICRYCGKLSVHLAGLVSVNQNLKRASRSLFPQWVKVIIACGLKA

SEQ ID NO: 786048 - protein, 244 aa, Homo sapiens
TSSPAAVRSQPTSGELRGARGTRLRPGRGEGARALLVGAVRRGFGSPGPGRGARGEPHSLCSALQERGGGQRSGPGAVAFDYRGRWRSGKVGSTLRDPHTSPGRHGPPSAEPRGLRRRRTSAACALRPQSKPHPVTSRSLVTPVPPGPAARWRRRGSLSKPDGRSSFSNWGWSPVTLPQITAAGERRDFPGLHRAPPGTHSLAGPAPFEHQLRLDLEEISLCSANEFFHRDQLRPGCSRCLVAD

SEQ ID NO: 786049 - protein, 172 aa, Homo sapiens
EGNGSGPFLPELLKHRPAERAPRSPRRRGSAGGAEDSVGGLGRSPRTCGTRPGAQTRTLQQVALPPLERVGSRRRRPGREGGKGRDRRAGRLPLPRRPRRPMRPLRAPSPGVLIASPCPRSRPLRCLWQPGSRARLTWVRGCRVTFHAGPTPVPPSQHTWVPERARWFRGGG

SEQ ID NO: 786050 - protein, 167 aa, Homo sapiens
APPVCSIPTCVLIPTCVLHPHLCAHPHLCAPSPPVCSIPTCVLHLPPVCSSPPVCSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSG

SEQ ID NO: 786051 - protein, 230 aa, Homo sapiens
AGTARGTVDERVFWHTRVRTCASADLPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSG

SEQ ID NO: 786052 - protein, 372 aa, Homo sapiens
YSRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKSDERRWIEKQNRATRAQRKKEEMNRIRTLVDNAYSCDPRIKKFKEEEKAKKEAEKKAKAEANGRTQKAKRKTKTAALAAARISKETEEEDSRQQALLGNSKGQTGYPKKALTNGKRQTLEESCTVIDERKWIGKAKQIHNEHRGEKGKSGSRTFVRKGYRIASKENNSRERKEKDSQEEKKNNQGREDGRENEDGLTAKITEQQGSTKMVRDAPIEREPRQWMGKGHNDTSDTEGREEHNTGGIILNKR

SEQ ID NO: 786053 - protein, 128 aa, Homo sapiens
YSRDERRWIEKQNRATRAQRKKEEMNRIRTLVDNAYSCDPRIKKFKEEEKAKKEAEKKAKAEAKRKEQEAKEKQRQAELEAARLAKEKEEEEVRQQALLAKKEKDIQKKAIKKERQKLRNSCKTWNHF

SEQ ID NO: 786054 - protein, 110 aa, Homo sapiens
MLMLRLPKERVSGKAIALIMVFDKQEEVCCSFFFLMPYFVQHTSNQSYPIDATPKYLWAWPVLRALPSFSYCTCLLPVLLVSCLDSPRPAATLLPKSSRKLTSGKAQFQT

SEQ ID NO: 786055 - protein, 71 aa, Homo sapiens
GRGFVEGRPGLGKLGRKGRHEDGVPRRESGAGRGSPFPGIGTGACLLENPSLLCGPPALAGDTEGSGVMDP

SEQ ID NO: 786056 - protein, 171 aa, Homo sapiens [sequence omitted]

SEQ ID NO: 786057 - protein, 137 aa, Homo sapiens
MRWHRSVIPQAGSLPSWSEPLTPRGHEHLDLQGQRGLRGQPPPLFRGQDFCPGAAGNGTLMPTTQPADFGPSLQYVLAAQGCPLREPWQDPLLHCWKLHPPVFTPLSLTSRFSEPGLQLQPLQRGAVRYVAVSHTLV

SEQ ID NO: 786058 - protein, 124 aa, Homo sapiens
KKTNKQTKKNKCNECDKVFSNSSNLVQHQRIHTGEKPYKCHECGKLFNRISLLARHQRIHTGEKPYKCNECGKAFRDCSGLTAHLLIHTGEKPYKCKECAKVFRHRLSLSNHQRFHTGEKPYRC

SEQ ID NO: 786059 - protein, 303 aa, Homo sapiens
CKHVEKPINNSLVSPLQKIYSSVKSHILNKYRNDFDDSPFLPQEQKAQIREKPCECNEHGKAFRVSSRLANNQVIHTADNPYKCNECDKVFSNSSNLVQHQRIHTGEKPYKCHECGKLFNRISLLARHQRIHTGEKPYKCHECGKVFTQNSHLANHHRIHTGEKPYKCNECGKVFNRNAHLARHQKIHSGEKPYKCKECGKAFSGGSGLTAHLVIHTGEKLYKCNKCGKVFNRNAHLTRHQRIHTGEKPYECKECGKVFRHKFCLTNHHRMHTGEQPYKCNECGRPRRVDHEVRRSRPSWLTR

SEQ ID NO: 786060 - protein, 233 aa, Homo sapiens
MRVRELLEEAVCPLAELKSYAGRSAALFRASRQQCLSLLKLRPQPPLHPGALSQGEGSFIYKPLTGSAAFLSDMPCPVRRNVERQSGHSGFAMLQLVLPSPKFLAALFDTVRGKPPIQASVMAGALPPMKSYHPRSTSDCCADSENFKRVDLSLLGSIGVPPVEQDHLAPWLQSPFQGSEQFCLAGVPGTTGVWKKNLLQLAQCLPKQPPSFVLETQGPSCTGTRGNLLVCGM

SEQ ID NO: 786061 - protein, 125 aa, Homo sapiens
MLLPPGSLSRPRTFSSQPLQTKLMTHNGLFRPIPYLTAVSADEPTASQQPPQAQLHHYNGLFRPSSCLPAFSLGPELSEVDLTRPSSCFFAASPGPAPASWWPLQAQPLPPVGLYSPNICLIADS

SEQ ID NO: 786062 - protein, 120 aa, Homo sapiens
GCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQIIGVSIKRN

SEQ ID NO: 786063 - protein, 81 aa, Homo sapiens
TATMVRMNVLADALKTINNAEKRGKRQVLIRPCSKVIVRFLIVMMKHGYTGEFEIIDDHRAGKLCEPHRQAKQVWSDQLQI

SEQ ID NO: 786064 - protein, 246 aa, Homo sapiens
KEVPAVPETLKKKRRNFAELKIKRLRKKFAQKMLRKARRKLIYEKAKHYHKEYRQMYRTEIRMARMARKAGNFYVPAEPKLAFVFRIRGINGVSPKVRKMLQLLCLRRVFNGTFVKLNKASINMLRIVEPYTAWGCPNLKSVNELIYKRGYGKINKKQIALTDNALIARSLGKYGIICMEDLIHEIYTVGKHFKEANNFLWPFKLSSPRVGMKKKTTHLVEGGDAGNREDKINRLIRKMNQGVYHD

SEQ ID NO: 786065 - protein, 112 aa, Homo sapiens
LQSNTPHTHTCMPMTHACMPRHVHTRHAHMPHTHASHMHTCMPCTHKHTHIHTHHVHTCTPTYTHSVHKHTTYTHAHPHTHTHMHRCGLEPEARGKNRSENGTNRLGAVAHA

SEQ ID NO: 786066 - protein, 136 aa, Homo sapiens
VRVAVGRRPQFFTFWTPAQGCLSSLTTWQLTLAIVSDSRESKMEAAISMMTWSQSVISTTGNTGWPSSSPSSGMESSMPWPCQWDFCMCWERRKVSFEPCQDLVTVSTEQDFRVRVLHYEDRSRGASSRRQWLPLR

SEQ ID NO: 786067 - protein, 70 aa, Homo sapiens
PMLPLQVQVQVQVQVQVQVQVQVQVQVQVQVQLWQGLAPAACHLVALPALSQLLVGSGSLFSRTSVPIEP

SEQ ID NO: 786068 - protein, 385 aa, Homo sapiens
MGCGASRKVVPGPPALAWAKHEGQNQAGVGGAGPGPEAAAQAAQRIQVARFRAKFDPRVLARYDIKALIGTGSFSRVVRVEQKTTKKPFAIKVMETREREGREACVSELSVLRRVSHRYIVQLMEIFETEDQVYMVMELATGGELFDRLIAQGSFTERDAVRILQMVADGIRYLHALQITHRNLKPENLLYYHPGEESKILITDFGLAYSGKKSGDWTMKTLCGTPEYIAPEVLLRKPYTSAVDMWALGVITYALLSGFLPFDDESQTRLYRKILKGKYNYTGEPWPSISHLAKDFIDKLLILEAGHRMSAGQALDHPWVITMAAGSSMKNLQRAISRNLMQRASPHSQSPGSAQSSKSHYSHKSRHMWSKRNLRIVESPLSALL

SEQ ID NO: 786069 - protein, 78 aa, Homo sapiens
SKALVYKRRSLGMKYNTDPGVLKSLAVGLFPPGYRLTSCFPAFNVLDNVCLLTGDKRQVSRRVSLCPGEARFLPAGKR

SEQ ID NO: 786070 - protein, 107 aa, Homo sapiens
PFLPLTPQLCVVEVLPGVLCSRQVWSKRQGLSSQLLVWLFISPWEGKAAGLSLHSTPPLPAHPCVAESLLQAGTAERTFPQGPPGAWKLFSRCGRLRMLGPCRPNSS

SEQ ID NO: 786071 - protein, 78 aa, Homo sapiens
GEPRKRFPGSIERVRFRKKDSSRISNIRAKSSRTRTKRCSLNLPMKRPLLGRSVSGGSGGRTASVKETLQPPPPSFKH

SEQ ID NO: 786072 - protein, 44 aa, Homo sapiens
DHITPLLWLLSHSESSWELCPDPGLCAICPYRSLGLPLLPTYSQ

SEQ ID NO: 786073 - protein, 135 aa, Homo sapiens
YILPNNNVNNNNNNSRTYTKLSEYLPESSPRLMLPVPSLFPSTAILYLAPTLPVCSWDGLSRRPVLWLWFCLAPPGEESVEEIGAEALVVLTLSPPGSGLAVALFLSERPSSSWRPVLSCVATGLGSETSISVSL

SEQ ID NO: 786074 - protein, 226 aa, Homo sapiens
MLLRLVSNSWPQVILPPRPPKVLGLQAPRRARKRAEGTASSNVFSMFDQSQIQEFKESLALSPRLERNGMISAHCNLCLTGSSNSPASASQAFTIMDQNRDGFIDKEDLRDTFAALGRINVKNEELEAMVKEAPGPINFTVFLTMFGEKLKGTDPEETILHAFKVFDTEGKGFVKADVIKEKLMTQADRFSEEEVKQMFAAFPPDVCGNLDYRNLCYVITHGEEKD

SEQ ID NO: 786075 - protein, 304 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 786076 - protein, 287 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDHALWDHTAQNLLRMGLAFLVLVALVWFLVEDWLSRKRTRERASRASTWEGRRRLNTQTL

SEQ ID NO: 786077 - protein, 192 aa, Homo sapiens
MSSTLPALLCVGLCLSQRISAQQQMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDHALWDHTAQNLLRMGLAFLVLVALVWFLVEDWLSRKRTRERASRASTWEGRRRLNTQTL

SEQ ID NO: 786078 - protein, 209 aa, Homo sapiens
MSSTLPALLCVGLCLSQRISAQQQMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 786079 - protein, 304 aa, Homo sapiens; identical to SEQ ID NO: 786075

SEQ ID NO: 786080 - protein, 73 aa, Homo sapiens
TSLFAFWPEAESASHGSSYRMNQEAAPRISELPKATAVMYTHSEALFLYSHRLVEKLNHILCLIFDFVVTNSR

SEQ ID NO: 786081 - protein, 107 aa, Homo sapiens
MENTKQGGKRRAGKIAWGILQVQERGEGSSAEGGMAISFRTCLTIEPIGLADGVAVEHKRKGRSELHLGRSVTGSALHHSGKRWGKTGCSTEPQSWLVSVSSGMDAQ

SEQ ID NO: 786082 - protein, 179 aa, Homo sapiens
GPQRSALLQAWGGQPEALSELTQSPPGDDLAPQDLTGKSRDSASAAGAPSSQDLSPPDVKEEAGWVPERPGPAEEEEELEEGEGERAGVPGRSPRGRAHRRHPQERWRLEYLMELDGGRRGLVCGVCGGALASLKMSTIERHIRRRHPGSTRLGGPVQALIAREWSEKAAHLLALGPPR

SEQ ID NO: 786083 - protein, 134 aa, Homo sapiens
VGDCAGSWGWMHGGARGSGPGCSPTEPLSGSPQVMETRQVSRSPRVRLLLLLLLLLVVPWGVRTASGVALPPVGVLSLRPPGRAWADPATPRPRRSLALADDAAFRERARLLAALERRHWLNSYMHKLLVLDAP

SEQ ID NO: 786084 - protein, 260 aa, Homo sapiens
RLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDL

SEQ ID NO: 786085 - protein, 43 aa, Homo sapiens
ECGGQEEEEEGQRCRVGFQVAQLSSHHLPNAVRQMLFQALDIY

SEQ ID NO: 786086 - protein, 75 aa, Homo sapiens
RTSDGISVINLKGPGRSCCWQLVPLLLLNPAEVPVLLQEHWPAGCAEAHCCHQSHSSCWPLLSWNLHSPDPGSLP

SEQ ID NO: 786087 - protein, 102 aa, Homo sapiens
APMASDKWNDYRQINRQISLDSDWVSFVFICLTEPHLVSFVSRSLSYHFAHSRGTCFIKIRSSRSDLASFLGQSPLPVDVGYILLWGSQGNTAVQPILWRAS

SEQ ID NO: 786088 - protein, 110 aa, Homo sapiens
TIYKRKRFIGHTVPRGWGDLTITVDGERHISRGRQEERIKSHLTWMVAGKESLCRELPFLKPSHLVRLIHYHENSAERPTTIIQLPPTGFLPQHVGIVGVTTQDEIWVGT

SEQ ID NO: 786089 - protein, 87 aa, Homo sapiens
RCRLSPLSLTRKGNSLIPCASQVRQCLALLRLAHGALHPLSCTHCLALPSEMNPVPQMEMQKSPVFCVGHAGSCRPELFLFGHLGSS

SEQ ID NO: 786090 - protein, 126 aa, Homo sapiens
CAAWLYMVTRNTAANRTQVRVCVNAVNSSLHTRFQQSPRTRGQHTPGHVIVTSEAVPHPTTTVSFMPGPMKVNASSGVCVEPVRPRSTVVAAGAVASVLASVAMQGCLSFPFSECPSGVYAPSVPV

SEQ ID NO: 786091 - protein, 175 aa, Homo sapiens
MGDCGFQSYSHSLLPSLRRSSAVTCQPIRACVCLVHDLVISNDLLLCSSALHFSHPHCWLPRPMSPPGTAPPLKLLNQAPLYPQPSGPPAHSQSLVGHGFQTQRDTRPCFLPCYPFCLHFPPSPTEVPWSIIRALFCQHPQLSWPPDSWSHPAGSPPALEESQQPPAWSRSPPTS

SEQ ID NO: 786092 - protein, 143 aa, Homo sapiens
MDRGTRDEHLPSCPGCPAVASNTRCCPPAACLPGISLSRAGTVSSPSCLLHGMDSGALNRCSEINDSESRSQPENVLLRGPWNLPLVHLGFSLLNKTDSAACSSEKVLVEDSPQVPLPGSPTAPEGWPSDAWVAGLLDPSMDK

SEQ ID NO: 786093 - protein, 71 aa, Homo sapiens
LVTGYGKNAYQFKPTHAHTHTHRQHTRKWAGDLNTCLMNDDTPKASRPVKGTRYHQGSSNHEMPLHQDGSK

SEQ ID NO: 786094 - protein, 102 aa, Homo sapiens
TPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVT

SEQ ID NO: 786095 - protein, 108 aa, Homo sapiens
MGVKQPGDIGSGRPDAQGRSQPPPCSHMLSFFHGRLRHHFTFQEHGADGRVTSPPKPSHDCPAWAQSLPWSSWGRSQPGHHPPLRPPPTAHFHPSQSGAIPVLGELGP

SEQ ID NO: 786096 - protein, 86 aa, Homo sapiens
LFQEVQRDAPHRKGSATVLPRCPPWVPSLKHRTSHTSSPAVPLILVPRLPSLQLHSFIQHSLGDFYIDTPRTEAWGKDDQEHVPSR

SEQ ID NO: 786097 - protein, 101 aa, Homo sapiens
NDKRNVHRFLHTCVHMPMCTHTHTQAVLSTWEGQFSNVASFTSLKRIPLSIIYIHSSHSPRRFVKVCQLRQEKALELTEVYVSASLKLQLYHLHCHFHTAV

SEQ ID NO: 786098 - protein, 119 aa, Homo sapiens
HLAHLTKKRMEWAEGRWCSRWRIGFTRPLPVAFDSAEGSPFWKHSFLQAPVATLPVFLLLLWPFFLSLLCWLFLLNLVLFPILSHYIFYLLSPILTASINIYKPRFHNSTVDKRLSSEL

SEQ ID NO: 786099 - protein, 202 aa, Homo sapiens
MNKREKLTYETNEQNSRTRSQTNQGQTRPENNKRTAQNKKQADNETATRHRRSAHDNKQNKYDKTRKTKIQRKRTEDIKVKQQKGGTKRWTDSKKYGHKRGQKGEEAETEEREKEQDKKRRKARQQNKPRRKRKHTKQNKRESDKKRAQKEKEQARRERGQEENSRETKKTPSATEGSTKEGRGRKREEKGENREIERGEER

SEQ ID NO: 786100 - protein, 211 aa, Homo sapiens
HCGRTFSHITGLTYHQRRHTGEMPYKCIECGQVFNSTSNLARHRRIHTGEKPYKCNECGKVFRHQSTLARHRSIHTGEKPYVCNECGKAFRVRSILVNHQKMHTGDKPYKCNECGKAFIERSKLVYHQRNHTGEKPYKCIECGKAFGRFSCLNKHQMIHSGEKPYKCNECGKSFISRSGLTKHQTKHTAESLKTKFNVEKPLDVLLTSGFK

SEQ ID NO: 786101 - protein, 952 aa, Homo sapiens
ESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHADFAAATLQRTHRTNRPLPPPPSQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 786102 - protein, 101 aa, Homo sapiens
MLLWGRYGIHSCMCPRVLPQLLLYLLTCAPPPTRGGAQRVQGSGICPCWRQHSWLVPAPMHSSSHPQRGQGTIWLRHHRLCFTLTLNSDSHIYSNVFDSCF

SEQ ID NO: 786103 - protein, 157 aa, Homo sapiens
MYVGEFENSWCFFQALSALTAATSALPPPARLQRDPRRKVEPKAAMKETPTRASLFQSGGPGGWRETRSREATPRPGAPTPRQQWRASPPGPSDADPAIRMLREVGHPHVPDSSGSARSRNPSGVGSGHTGVCRPRNRCSCGGDPKRDKAPRQYGLQ

SEQ ID NO: 786104 - protein, 77 aa, Homo sapiens
CEDRIGSIYHKSLRKGKETQITPSWWAWTLTFDKDGNSNQHTGGRKGTITNSFGGKKSSECGQVTQVVLTLAERLCR

SEQ ID NO: 786105 - protein, 74 aa, Homo sapiens
CPQLPQDPEASLWRACDLNPSTRLQISAVCPGLIKPGCPVGIGVTCLAELGTPWEEGGCCEKAVDPGCATFAGG

SEQ ID NO: 786106 - protein, 50 aa, Homo sapiens
MGVPMSEGAKVLELGPVPGLALVGDLEPYAGAPGQPWRHGMDSVSAAHRG

SEQ ID NO: 786107 - protein, 530 aa, Homo sapiens
SAEISAAKLRLPPRAVPRGSPEADHPHPTSSGFARGPPSSHPRQTPVGSPSLTPRPRVNCKGPAHSQFRGGCSHRPELPAPSRGPWGRRRPQRGGRGGGGRTRVSLENEDSEGGTFGRPPGGASHETVPLLCQTLNWALDGHHLLIPEHPRELHRIPISWAMSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHKRTKKHDLLR

SEQ ID NO: 786108 - protein, 593 aa, Homo sapiens
SAEISAAKLRLPPRAVPRGSPEADHPHPTSSGFARGPPSSHPRQTPVGSPSLTPRPRVNCKGPAHSQFRGGCSHRPELPAPSRGPWGRRRPQRGGRGGGGRTRVSLENEDSEGGTFGRPPGGASHETVPLLCQTLNWALDGHHLLIPEHPRELHRIPISWAMSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHKRTKKHDLLRLAKEEVSRQELRQRVRMADNEVMDAFRKIMAGPAEEADSTKKEKDQAWKTLKERESILKLLDG

SEQ ID NO: 786109 - protein, 562 aa, Homo sapiens
SAEISAAKLRLPPRAVPRGSPEADHPHPTSSGFARGPPSSHPRQTPVGSPSLTPRPRVNCKGPAHSQFRGGCSHRPELPAPSRGPWGRRRPQRGGRGGGGRTRVSLENEDSEGGTFGRPPGGASHETVPLLCQTLNWALDGHHLLIPEHPRELHRIPISWAMSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKDPTPGEALLPALGPGGHVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHKRTKKHDLLRLAKEEVSRQELRQRVRMADNEVMDAFRKIMAGPAEEADSTKKEKDQAWKTLKERESILKLLDG

SEQ ID NO: 786110 - protein, 474 aa, Homo sapiens
SAEISAAKLRLPPRAVPRGSPEADHPHPTSSGFARGPPSSHPRQTPVGSPSLTPRPRVNCKGPAHSQFRGGCSHRPELPAPSRGPWGRRRPQRGGRGGGGRTRVSLENEDSEGGTFGRPPGGASHETVPLLCQTLNWALDWASSLNPQNIPGSSTGSPYPEAMSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSWQRRR

SEQ ID NO: 786111 - protein, 91 aa, Homo sapiens
SVTHAHFQLEYPLYSPSERSVTHACFQLEFALSGFRSVTHARFQLEYPLYSPSERSVTHACFQLEFALSGFQSVTHACFQLEYSLYSPSEW

SEQ ID NO: 786112 - protein, 105 aa, Homo sapiens
NHEKYDNSLKIISNAFCTTNCLAPLANVIHDNFGIVEGLMTTVHAITATQKTVDGPAGINCRQCTSAFAAHCAKFLCATRLSWLGGIGESLWIKVNIPIIIFQVA

SEQ ID NO: 786113 - protein, 109 aa, Homo sapiens
MPLPYSLADSKTLSQNKTQTKQTTKENRSNGNLRTEKYNNLTEMAQEKNEDGEGRMNEFENITTEIIQSEQEPVGLLKKKGQLGSVAHACNPSTSRGQGGWVTRSRDRD

SEQ ID NO: 786114 - protein, 110 aa, Homo sapiens
NYHPDNCCSHKKVGSTCVENSNSEESYNVKQKNKSFSPSPYYYQFLLKFVPVLLHVFAVVSAFTKCKQCSIACLFNTLLEGLSDIKNITILLFSAILEYFTYWNLIKPPS

SEQ ID NO: 786115 - protein, 101 aa, Homo sapiens
FLNARFLLGGAYLKVPGRLTGPLHCPFLWHLQCTLQVTSCTVPCYFAPWHLTIGLFLPFRNSFWAGSIWMAQAWVLSMLSSWSVGNSHILSMPGAEIKSTH

SEQ ID NO: 786116 - protein, 95 aa, Homo sapiens
MCNWFINGWQWRLPDCKDANQFTLSRGGGEASDVAQPSGSSPSGLPVSVPAPTDVLSLCVCCVLLCSGQRGKPAAPFPRREPEPPNTLTPGSTLT

SEQ ID NO: 786117 - protein, 107 aa, Homo sapiens [sequence omitted]

SEQ ID NO: 786118 - protein, 386 aa, Homo sapiens [sequence omitted]

SEQ ID NO: 786119 - protein, 69 aa, Homo sapiens
TTEWQVFLTYVCDERRRQWQRPQGCRNKADVTVVGVTGQEILLKETDISNAREGRQLHRRLTEGLPYLM

SEQ ID NO: 786120 - protein, 73 aa, Homo sapiens
EENGPRPYHRQHVHVSAAELHRRREKSQQESTARLAPVRHKKRSLQRHSESRQKSNCEAGPSDIHEGKSGAVL

SEQ ID NO: 786121 - protein, 35 aa, Homo sapiens
MAIIKKITLRITYYFQLQLFRVVALGRRGTRARNC

SEQ ID NO: 786122 - protein, 117 aa, Homo sapiens
VAMRTTPHWDGEPGQVGGQGARLCPSSMTGHSNGLFASLPSCPSHGHLPFSVLFFCCLFYPPALFSPFFLLFRLSAIRFLSPCLFLSLRSPFHCISVYVSLLSSKIVFVCDFSWFLC

SEQ ID NO: 786123 - protein, 172 aa, Homo sapiens
MNPRPSNSQRKVGVKQGGLQTAQRGQGQKSEEIRWGCPKSQVTQPPGCCSHPPVGGALFFSIKVLSILRWSLTLSRRLEYSDAISAHCNLHLLDSSNSPASASQVAGTGAHTHWANRYTGTADQNSIRIVRKLGGAWEDGWGMGGRGTRAGERLWAKTPQKHPGATKADYDV

SEQ ID NO: 786124 - protein, 72 aa, Homo sapiens
TRTHKHAVTHRCIQTRNHSATLPPPTELPVSLEEQKAKQETPAHWMEGPGQEGQGQMEVGGAAGGWWGQPEG

SEQ ID NO: 786125 - protein, 82 aa, Homo sapiens
MAAWGSVGGQSLPRALQDDASGVLGPGHGAIRQTAPCLQQAALHLTSWVSTGHSHRTDIQKCTRTHTHMHARTHTLQVRHAI

SEQ ID NO: 786126 - protein, 68 aa, Homo sapiens
NLRSSSWDRGMRALNHEWHRSQKLVSLYKDSATTQLSDHRESSLMMGDAPSVFSCDLLHRSVPPRIWR

SEQ ID NO: 786127 - protein, 35 aa, Homo sapiens
MRKQRLSLQYRGDLKLGQVTAAPRLLTCRPFPLQR

SEQ ID NO: 786128 - protein, 39 aa, Homo sapiens
KFIISGHLRAPEFRPLSASRMQNSGRASKSVAPWVLRFG

SEQ ID NO: 786129 - protein, 38 aa, Homo sapiens
GQPVASRMDHTEVLQTLAPRRMDLLVCQKCFPAIRMQC

SEQ ID NO: 786130 - protein, 101 aa, Homo sapiens
IIRPIANWQRVISFSIYIRGYRETIWLSCIFDNSCPVKQITAPLEIIFSFSFQHSSLKIYFSISLYLCIPSLKEKEIIFLLLFQHSFTFTLNFKPSRTGLL

SEQ ID NO: 786131 - protein, 101 aa, Homo sapiens; identical to SEQ ID NO: 786130

SEQ ID NO: 786132 - protein, 118 aa, Homo sapiens [sequence omitted]

SEQ ID NO: 786133 - protein, 262 aa, Homo sapiens
CQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECL

SEQ ID NO: 786134 - protein, 50 aa, Homo sapiens
MAEDPRYHPSAQRLKGAQHPSSPSLQGLLFTVDVSSFCPEPSTVPVTNGE

SEQ ID NO: 786135 - protein, 91 aa, Homo sapiens
TPATSIRRAYPYLPSFIPKVTGSELTESFTTRCLTLRGSGSAPSRLRRRPIAETIVFSLSLWITAQRQGLPETLASPAAASHSCTCGMRVR

SEQ ID NO: 786136 - protein, 73 aa, Homo sapiens
CALLLFCFLPWNDSARRPSPDALFLTLDFQFPELPNLVSCCELQEKEKGSLGSTAEELMAVRDGAKIGTEVWL

SEQ ID NO: 786137 - protein, 189 aa, Homo sapiens
RIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFT

SEQ ID NO: 786138 - protein, 87 aa, Homo sapiens
NPLPSLHLHLLCAWVHPVDTAGLRDRRLVGLLSDERINKQLPAATILQDRHLLRAGHVGPARALAAWKCSRCSPRGIRGWGAVPRKW

SEQ ID NO: 786139 - protein, 31 aa, Homo sapiens
MSEKTGEPAAENRDKEASVAGAQITLQTQTP

SEQ ID NO: 786140 - protein, 159 aa, Homo sapiens
RPPLGPPARAREAASRPSPGRRVPEGAGQLLRGQRAPGLGAEAQRPETNWADRGRLPASPGVHCPGSSSLPRSDSGFILSCRAPSGFQLSLLEFLQPPRIAGPRYMATHDPERPLPGTGSGDWLRLSSVPSVHGSRSCCSRFGEDHGLRAPVVEFGELS

SEQ ID NO: 786141 - protein, 123 aa, Homo sapiens
VRCDLLFLAFCHDCEASLAMWNCYYIREKSKQVITLLMDEPLLCKEREVACRTRQRTSHSILFSKRQLGSSNSLTACTSAPTPDISASEKKYKLPKFGRLHNKTHGSRSDFNFQVLLLKKYIS

SEQ ID NO: 786142 - protein, 217 aa, Homo sapiens
MAFRRQVKNFVKNYSDAEIKVREATSNDPWGPSSSLMLDISDLTFNTISLSEIMNMLWHRLNDHGKNWRHVYKSLTLMDYLIKNGSKKVIQHCREGFCNLQTLKDFQHIDEAGKDQGYYIREKSKQVITLLMDEPLLCKEREVACRTRQRTSHSILFSKRQLGSSNSLTACTSAPTPDISASEKKYKLPKFGRLHNKTHGSRSDFNFQVLLLKKYIS

SEQ ID NO: 786143 - protein, 67 aa, Homo sapiens
LSGRARCAVAVPPVASHLAWTAGRPHLQAGLGVAAALGLCPPLSTDAAMSTCMAHLPDLSTPVQRLP

SEQ ID NO: 786144 - protein, 550 aa, Homo sapiens
DRPFSGAGLHSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVR

SEQ ID NO: 786145 - protein, 724 aa, Homo sapiens
AIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKTESEYEETFKPSSVVSTSSTSCVSTSQRKETSTTRYSDHSVTSSTLAQINATSSGMTEEFPPPPPDVLQTSVDVTAFSQSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVR

SEQ ID NO: 786146 - protein, 393 aa, Homo sapiens
DIQDGGWVMLIGKKNSPQEEVELKKLRHSLEDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVR

SEQ ID NO: 786147 - protein, 96 aa, Homo sapiens
WGSGPREGGFGGMKEKQAEFPGTTLLQTGDMFCTPHFVRQAGETSWWCGFSSPSGTSGLLRYEPCNAKRVGVFSHVERGSEQKRRSVSRASIFFRG

SEQ ID NO: 786148 - protein, 126 aa, Homo sapiens
MKQEEWVALKPAVLHGLVGDGELAQVVADHLRLDLHLVEGLAVVDAHHAAHHLGHDDHVPQVSLHHFRLLHGRHRRLGLAQALQQRVLLPPQAPVQPAPLVRTVQLYQLLVGHVQQLAARGPRRSR

SEQ ID NO: 786149 - protein, 80 aa, Homo sapiens
DGQQGDGCAVGSTGSSGASLDRGPRVAAFLFLHKQEYTNLQNEADLGLPSIDRQFYRVSISSSRCKLPGFEYWLHHLQAE

SEQ ID NO: 786150 - protein, 107 aa, Homo sapiens
RGSDSRNAALRVPDSGGCVRVASPRLDRRVPPTSPLWAERAECSIFLWNNGVMNWSPGAARRPLPPPSLLARAPAASLRGLPRGTQSREGPPSSLGDGEGVGASWGK

SEQ ID NO: 786151 - protein, 659 aa, Homo sapiens
APARGAWRLLPAARESDSGGGPGGGSGGGGASMSWLFGIKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGSLLFVDEADAFLRKRATEKISEDLRATLNAFLYRTGQHSNKFMLVLASNNQSSSTGPSMTASMRWSTSTCRAGGAGALVRLHFDNCVLKPATEGKQRLKLAQFDYGRKCSEVARLTEGMSGREIAQLAVSWQATAYASEDGVLTEAMMDTRVQDAVQQHQQKMCWLKAEDRSARGHVMPEDRTAGRVLGHGVSKDGVLTEAMMDACLQFQQHQQMMRWLKGER

SEQ ID NO: 786152 - protein, 657 aa, Homo sapiens
HRLAARGGCSQPRASQTRVGVPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGSLLFVDEADAFLRKRATEKISEDLRATLNAFLYRTGQHSNNPSHVSHGGSSPAGRTWVTPQARWGPKVHAGPGQQQPEQFDWAINDRIMRWSTSTCRAGGAGALVRLHFDNCVLKPATEGKQRLKLAQFDYGRKCSEVARLTEGMSGREIAQLAVSWQATAYASEDGVLTEAMMDTRVQDAVQQHQQKMCWLKAEDRSARGHVMPEDRTAGRVLGHGVSKDGVLTEAMMDACLQFQQHQQMMRWLKGER

SEQ ID NO: 786153 - protein, 630 aa, Homo sapiens
HRLAARGGCSQPRASQTRVGVPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGSCSLWMKRTPSFGSEPREDKRGPQGHTERLPVPHGPAQQQVHAGPGQQQPEQFDWAINDRIMRWSTSTCRAGGAGALVRLHFDNCVLKPATEGKQRLKLAQFDYGRKCSEVARLTEGMSGREIAQLAVSWQATAYASEDGVLTEAMMDTRVQDAVQQHQQKMCWLKAEDRSARGHVMPEDRTAGRVLGHGVSKDGVLTEAMMDACLQFQQHQQMMRWLKGER

SEQ ID NO: 786154 - protein, 114 aa, Homo sapiens
RNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQRNNYS

SEQ ID NO: 786155 - protein, 134 aa, Homo sapiens
EVCLRTEAGSDGSSSYPGPPIPLYPGVSFSSKHPFQSNKSGGRVSFFFFFWRHKKVLPLLLRPRGLGVASGATKKSLGALNGRKPSRPSLGASKGGIPLCALSKALPVGGISGAIWQGRCATPRCLGLTFPWYL

SEQ ID NO: 786156 - protein, 73 aa, Homo sapiens
EQEEEEEEAQEEEEEAQEEEEEEQEEEEEQRRRRRRQRRHCGSSTGCARRRSRLHCPEANKASSPSQGHTPNR

SEQ ID NO: 786157 - protein, 72 aa, Homo sapiens
PQPTRTPLDFILKTHLGTGKYAFSVPEQRIRNQITPPLSWTCHPYNKIKTRPGAVVHACNPSTLGGQGRWIT

SEQ ID NO: 786158 - protein, 160 aa, Homo sapiens
AKGGITAEEEGSLGCLQQPWAEEVPCKVTTMTPEEKIPTGVSPGLLARDYDLCPCPAIALWFCQQWVLQIISFLREPYSVLKLDSSSFESAWEKTPLDLQIYIVAKGPTNQIALSFPMVTLLRQPPPSQWSLFYDIPHMQKQEETGLLLSSTCKETQGVG

SEQ ID NO: 786159 - protein, 95 aa, Homo sapiens
ASDINSGNVLTPLSAGPWAQRRQGESRLRGCSRRTVLSPASSAGHCSLVLWTHVWVTGLPPRAKGKVSLLPTTSGIHFAVGYGKVQFWFSVIKVS

SEQ ID NO: 786160 - protein, 240 aa, Homo sapiens
AFPGLLPVNRMLCQSPPLRPRPRPGSLAKPLPSRRPQPAGSRRLAGQALWRGRELGAHGYRAWRRHCPASDGGPGALFHRRRPSRAGGLGVPAHPGAFPFLSPCWLLLLTFQLRGRHRNDKGKNSFSLKTVEQLDADGMFQTLNSSRIDMVAEIPGKFYKGTHLRKTIPHDVVWSTGSYSPQAGRGPGVPGHRYIEEFSNLVARTPGAYPIVLWYQGLSFKYVVDYDAAGHDVSAATMTL

SEQ ID NO: 786161 - protein, 46 aa, Homo sapiens
PDRKRDSLGRTVWFEMVAGSMHLHLAFLPKETVCFLKAAPVLATGY

SEQ ID NO: 786162 - protein, 74 aa, Homo sapiens
DNRGRHPAPGAWGCWNPPLSPSPSAQAPGSQGVGGDTRIHKRETEVCMKRADGWESGDLDLALTVPCRLLSLHL

SEQ ID NO: 786163 - protein, 230 aa, Homo sapiens
SLIPYVQVLAKATSRTTNFSLVTSGACPFPAWPLRHELPGLLECSSFTPTSGLPGPQRSLQQPHDPSRPQVTCDHPQPLGNRSASLLVDFMPLSSPRDSSLLEGGDYLPYFLPYHSGWNLPPVTCHPGHTSIWDYPIARVLFLFLETGSHSVQFTQAAVQWLDHSSLQPPTPELNQSSSLSLLGSWDHRHTSSGPAKKNFFFFEMGVSLLLPRVECNGAISAHRTFRHPG

SEQ ID NO: 786164 - protein, 154 aa, Homo sapiens
DHTDQPELSTELAWEIDRKALHQHRLQRTPIKLRCCALDPVTSAKETIGDIGLDLRTAQETKQAPKWYQLLSNKYTKFKSEIQISIALETDTKPPVDSFKAKGAPPRDGKVLEAGKFKIKALASGEGLRPTSSHIGRLKSKRGTLSTKPFYKGT

SEQ ID NO: 786165 - protein, 273 aa, Homo sapiens
DHTDQPELSTELAWEIDRKALHQHRLQRTPIKLRCCALDPVTSAKETIGDIGLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRA

SEQ ID NO: 786166 - protein, 135 aa, Homo sapiens
SPLSSGNNAEYAGSSGNNEYAGSSGNNAEYAGSSGNNAEYAGSSGNNAEYAGSSGNNAEYAGSSGNNAEYAGSSGNNAEYAGSSGNNAEYAGSSGNNAEYAGKQWYNAEYAGSSGNNAEYAGSSGNNAEYAGPKS

SEQ ID NO: 786167 - protein, 36 aa, Homo sapiens
MTNENALSGNEELTVKIKCDKVKNLLHVTDTGVGMT

SEQ ID NO: 786168 - protein, 96 aa, Homo sapiens
MLRVITVKTRTMTTIVHTTEESTKKNKKKPPKKTSRYERTDTGEITSYITEDDVVYRPGDCVYIESWRPNTLYFICSIQDFKLPFRYFSKSSLRLE

SEQ ID NO: 786169 - protein, 67 aa, Homo sapiens
VSHCTWPKVTFCSVGHLYAASSAVPVASPPTAAAPEQHVMGTVCRSGNSPTHTIQHESRPATRPKVQ

SEQ ID NO: 786170 - protein, 36 aa, Homo sapiens
MSMKRVKLCEVFEETYSEPNMSDQWLMTQPQEILRT

SEQ ID NO: 786171 - protein, 226 aa, Homo sapiens
RISVKVFFTCGWTKIRDVLIQKSQMTEPGPEVKKKTEEEDVECEDDLILACQPESSVKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKVRKDKKRNEH

SEQ ID NO: 786172 - protein, 27 aa, Homo sapiens
MSAMTTHKAIQTSKKNKQNYTKPTTSV

SEQ ID NO: 786173 - protein, 79 aa, Homo sapiens
DSQSSAERNGKSLHDLASLIIERNGKSGHEGDSPVYKIIGVELSMRQVGRDTNVLNIRVHFFPPSTPRFTLDGKHINQK

SEQ ID NO: 786174 - protein, 78 aa, Homo sapiens
SQINSLIGGSKVQVSNNMLEAKATSYPSRMAQVKLELSCVMLPVTAVMVLLRTGLNRRHFKKANAKMEIPKTAIVQFW

SEQ ID NO: 786175 - protein, 55 aa, Homo sapiens
RDCKHAKCETPRPPTPLFPELYAPHKSPEDFSGESGPNANNKRYQYWEFPNSPPR

SEQ ID NO: 786176 - protein, 37 aa, Homo sapiens
MAKVIPIGDVALDVCESAGTEDCDSCPEMEVPTLATA

SEQ ID NO: 786177 - protein, 123 aa, Homo sapiens
NILCVLSITLLKFPKYITSACVLIILDTCEREGDIDFGFRIPTTFGFRLPTTFGFKSRSSSDVCSWCIKDKYWKLYTKNKYVLIYHESHGWSWQEVTALSFFFIIQETQEQHMPWVGHRVRTQ

SEQ ID NO: 786178 - protein, 67 aa, Homo sapiens
TQLPRQPLTCAFRDSIPDTTCPNLCLSSLTPSHYLADPAPGSWTNLLFLECSKPLLLQAFALFAPSA

SEQ ID NO: 786179 - protein, 109 aa, Homo sapiens
RDLAAVRSSDLRSLCRIRSRQQELSAHGIQSGSRVTMGCGGGGGGRWSRERWSRERGADLEKSLERITGQVEEADEELPGCAADQGRSGGRVKATVGNRAIYEDVEGRS

SEQ ID NO: 786180 - protein, 103 aa, Homo sapiens
GGLPSFPACRVRVSGCPADAVLDLLAPQTVALLCLWPRGKEKVAISTLSAREPVGTENGLWPDITCNQSQAAFGFSLLETTLPGLLHEGGAATSLGTLRCRYV

SEQ ID NO: 786181 - protein, 157 aa, Homo sapiens
EEQWIEVRTWRICYTQSWEEGQSQYQSRKKAGWEGEPESGDLPGRRCPASRGLTVVSMNCIPAVGWDRATDTVSEHRGGKEQEGFQLCQLAAVWLWACYLTSLSLIYFIHKMEIKIILLSKAHCEYLDPQNNAWLVANGSWRKRKRKPKSAAEGFSY

SEQ ID NO: 786182 - protein, 40 aa, Homo sapiens
MEVQKGPPLAGSGVVCEENAISSSPPPRPPLLPRPPCTAF

SEQ ID NO: 786183 - protein, 106 aa, Homo sapiens
MSLALLPRLECSSLITAHCSLYFPGSNNTPTSASQVAGTIAVCHYTWLYFVFFVEMGFCHPAQAALEFLDSSNPLTSASQSAGIICGNHICPTPSDFLPHLQLGTV

SEQ ID NO: 786184 - protein, 67 aa, Homo sapiens
IHPHPSPGLNVRAQTDLQIHSAPASGQLLCRPPHPIFWSVKLMHNGRSNGQVVIAGQKVPFKTGIIR

SEQ ID NO: 786185 - protein, 63 aa, Homo sapiens
MRPGQHQEPEQDPGPLQGPRKGRDLPRFCRASWGHPQHLIVRRPLLQMGLLWNTRPPATAGGY

SEQ ID NO: 786186 - protein, 144 aa, Homo sapiens
PRVLEKPSARASISVLQAGTLMLRELNPPSRANDGAGAVPKSKKEDPGWRNREERGAPHRSRNSQVKMGLQLRRSVGLGKGTGQNLQEWPEATSAAAGWRGRCTVDASVTTCARRFRDPDPFVRMSQNPEHHGGRKRDGILGKL

SEQ ID NO: 786187 - protein, 355 aa, Homo sapiens
AGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVSVAKTQSEARPGATVDARGNPNGMSREVAGVDMKSCAQSQAVTKIQGDDMPGTGVEDMGNCKTMSRAESGADTRASAQPQIFAKTQTEAIPGAKIDAGGNTNAMCKVGAGADVRACIQPQTVAKKQAEVTSGARVDGRGNTNVISKAITGADMRAAAQPQAVASTHAEAMSDAKVKNRGNPNAMTKAGAKANLRANSQVEALPDARDKSRGNPNVMAKVGDGTDMLSCTQPQ

SEQ ID NO: 786188 - protein, 191 aa, Homo sapiens
MYYLVAFQHRAWFSLFLIVRMMCSGMSHCERGPDDGAWTERVNGAAHLRTLPALLCWEQGAGQPGRGWSSSKGREEWPSGDHREEPCHDRLKKLDYANKKGKTSVTHRKQCSWPCHRRRSKGGKLRRLPVNSWLRMHVICSDLKTQTRTEVSGPTCEMHSAERHPALAAGWEAGCRMIVRGKKFCRSYQAP

SEQ ID NO: 786189 - protein, 41 aa, Homo sapiens
SRQLRQQLRLPICPRGSAAASAPGPSACGRADLPALRFPRA

SEQ ID NO: 786190 - protein, 146 aa, Homo sapiens
QNMTQSTQGNAKPSREKVKPSKGTRERKRQSKQETSIQATNAKPSQERKAKPSRYRPAKPLKRVQHARASHYRPAKPLRACGVRVQAVTGRPNRYARAACACKPLQASQAAAGRVRAACACACGVLISGGVRARGTDTGRCMQRAC

SEQ ID NO: 786191 - protein, 269 aa, Homo sapiens
MPWILEDLTMGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 786192 - protein, 123 aa, Homo sapiens
ERKGVRSRQGWRQRAALSGNLTTSSPSENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 786193 - protein, 128 aa, Homo sapiens
MPWILEDLTMGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 786194 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 786195 - protein, 119 aa, Homo sapiens
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 786196 - protein, 314 aa, Homo sapiens
MPWILEDLTMGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 786197 - protein, 121 aa, Homo sapiens
PASGRHSRPSLRSGREPPLGPPGPGARLPPGAWREALLRLFPIRAGARNQELQPGWRSSFLLPPGPANHLAAVLSGDGAGGLAPPASWVPSQTLAVNEGAGRSRPAPRPGLDWASEMFLQA

SEQ ID NO: 786198 - protein, 204 aa, Homo sapiens
TSVIRIFIPKTEEMQPTVEANQAAKEDTVVLKIGSVAMAPQADNPLGRSVLRKDIYHIRRHQERRAILTPVLTDFSVRITGAPAVIFTKVVSPENLHTEEILVCGHSLEVNITTNLDFFLSVAQVQLLHQLIVANMTGLEPSNKAAEISKQEQKKVDIFDGGMAETSSRYSGAQDSGIGSDSVKIRIVQIEQHSGASQHRIARP

SEQ ID NO: 786199 - protein, 102 aa, Homo sapiens
TSVIRIFIPKTEEMQPTVEANQAAKEDTVVLKIGSVAMAPQADNPLGRSVLRKDIYQRALNLGILRDPGSEIEDRQYQIDLQSINIGTAQWHQLKPEKESVS

SEQ ID NO: 786200 - protein, 132 aa, Homo sapiens
HIKSISYAGCLLQFFYFSMCAAEGYFLSVMSFDRFLTICRPLHYPTVMTHHLCVRLVAFCRAGGFLSILMPAVLMSRVPFCGPNITDHFFCNLGPLLALSCAPVPKTTLTCATVSSLIIFITFLYILGSHIL

SEQ ID NO: 786201 - protein, 82 aa, Homo sapiens
QIQKSEALIQGLSMAKSQVAAKLQETEQALQEQEVVLKAVTLERDQAVQALRMHGLPRPGAQMLLRQHEEEISKDFPSSEIQ

SEQ ID NO: 786202 - protein, 95 aa, Homo sapiens
EDPHTPRLHDIILIIGNTARAINDKHNVYNFNPLAFFTGAAYSKNKIIFNALQNVKILNIKNHLGPPTDLLKLGDIGAKHSHRIDDYTFLPKHYC

SEQ ID NO: 786203 - protein, 103 aa, Homo sapiens
KGNIDSKPRETWRWSIRRPPWGWATPAPRGLCSTFCGASPLPLPPGAGDLARAAGRGLVESTHAPVLCLVPHGPSAAPAAAGAPRRGSAFLSPLCTRRCPQHQ

SEQ ID NO: 786204 - protein, 67 aa, Homo sapiens
PPLLSTPQPQPLGPYKAGKGPPGRGEAAALQEFHTGPVLPLLLQEPPGEVRPSSRPCAPGDAHSTST

SEQ ID NO: 786205 - protein, 125 aa, Homo sapiens
LTCPSPQHRPQVHSQASETLITLFPLPRTSFPRLSLDLNPTQILTNASTSTSLRCSPPCLEGIHIEAPGNQVIFSRSLRSGGAKLQLKILACDSLCYYLPIFCFPLEMDRFVFSFRIISSDTFYR

SEQ ID NO: 786206 - protein, 128 aa, Homo sapiens
NRECISLDVYIITNTCVRPCYQPHLPPTSVDESIRPREGNTGMRWPLRTRLLKISSRQAPGPLANSCGLADNPRSLWSDSIYAALPRASSGLRSGPWSRSSRVCFLFALPPTAYPPEVRSSRPAWQTW

SEQ ID NO: 786207 - protein, 130 aa, Homo sapiens
PGGCAPGVGSRGTGARRAARGAWRVGERLVLLAQETLIAHRAPAATRSRPFHFLTLLNDSEVKTSTKRRVKGWSPPKANLRLNIADRLSLQKLQRRGCSSRLSPLCQAMNLNVRGVVCIESARARQEFKK

SEQ ID NO: 786208 - protein, 75 aa, Homo sapiens
LDTDANPHNAGRSKHSVATQGAGLSLCNKISLKNKGLHCFLARGFQCPGFGGDSRLLLKTEYKFVEIVTPVALGS

SEQ ID NO: 786209 - protein, 69 aa, Homo sapiens
RAAISSVTPEIKRIERTSSGPNSLMAHPQLSTWATLDTAVTSRFILAVLLRMKTSSAPCSFLDFARPDF

SEQ ID NO: 786210 - protein, 152 aa, Homo sapiens
MAQGCQGSVFCCLQQTTAHTRTHTRHTRTHTAHTRTHTTHTRTPWTTAWATTGVTATAGSPAWVHVPASFNACSLGTSSVPGLHWAQGHCGEQRQGPGQRGPWDSTWVAALPGTQLPYPSTCCGPSYRPSCLVKAQASGRPLCLSPLHVPSP

SEQ ID NO: 786211 - protein, 93 aa, Homo sapiens
KILKHPESPVSHSQLDIWLPCRNSWPLGQRADETDTRLHGDWAQGQVCLQYGCHFQKGMLISANMGLNRLSALKAVCGMRADEIQWLLANSMD

SEQ ID NO: 786212 - protein, 235 aa, Homo sapiens
ARGPRRPAQRERRGVPGLRDATDRSGAKRGRSRPRSGAAMSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQVPRAGRGGGCWALHRAPQSPRPSLESHSPQDPP

SEQ ID NO: 786213 - protein, 212 aa, Homo sapiens
SPHWSMWKKLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTEMDVMCAVMVENPLADMSASVIISEITLQKDLMIVESVGNLIVERAALFNIRESTLKKNHTNAKSVVRASVGVLISVFTRGSTGVRSPINVRNVVR

SEQ ID NO: 786214 - protein, 114 aa, Homo sapiens
SGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGK

SEQ ID NO: 786215 - protein, 102 aa, Homo sapiens
EDPASFAGWGRTSPSQLPRRWMLVWGDVGTSGKTHASPTCQPAWGQAFGVRTALSPNLLCFVFKLDLTSLVRLRQQTLDSSSYNRNLLTTYYVLFTLLALSH

SEQ ID NO: 786216 - protein, 248 aa, Homo sapiens
PQFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMNPFPDTFTTGPQFTADFRDSKLQCCPGPTSPLIPAATLRPLTETVLHSADHLHHPETCFSGSQCRDTPAGTGEREDDEKTVDDRTVKFSPCHLEDGMVPSVRLLSSGFVCSL

SEQ ID NO: 786217 - protein, 57 aa, Homo sapiens
LSHPGLENLVDWTQEYHFPLKSVTDHSRRHGFNISTSLLGSRSCCDLYSIQATLPPK

SEQ ID NO: 786218 - protein, 66 aa, Homo sapiens
MVGMAGGGLLALLESGTCIKVARDWASGCRAVTAAKGSLTYGGEGQRIFCGQDIWGIWGVTLYYLK

SEQ ID NO: 786219 - protein, 69 aa, Homo sapiens
MPNHYSFCFCFCFCFRRSLALSPRLECSGAILAHGKLHLPGSRHSPASASPVAGTKGARHHARLIFLYF

SEQ ID NO: 786220 - protein, 68 aa, Homo sapiens
PMIRQEVLGRDKEVAKGRHDPPESTAHLCTHDAIGTYPAYVCSMSLTSQPGLINLKANISMSGRRAWR

SEQ ID NO: 786221 - protein, 122 aa, Homo sapiens
SIRGSPVVCHAEDTADLEAQKSLVYTTCLEELDLVPLTSHEDHDFFQHVEMHLRSEHPPLCGRDHLSFRSYYFPVTNVIDGDLCEQFNSMEPNKQRNVSEELDRTPPEVSKKLEDIRTRYAF

SEQ ID NO: 786222 - protein, 76 aa, Homo sapiens
VLSEVTGAVPSCEARRQRVVASVHQTQKMKNKNTKMVSVGEFFTGELEYSGGRLTFCFGSRDATVGKYFLPGVHCI

SEQ ID NO: 786223 - protein, 102 aa, Homo sapiens
CRFLKKFLLERGSERYSPQFGQKAVSHNQQNQLHGKSGELGSLGCGAGAANVLHGPWLPGHCLKICWGLWVTEEGTGPIGGPLSAHPGPLRTVQPRVSFAPA

SEQ ID NO: 786224 - protein, 159 aa, Homo sapiens
MVQLLWKTVRQLLKKLNINLACRPVVPPLRIYPRATKTRSIHMRLHRRPQQHPHEDDADVHSSIHTRLRRRPQQHPHEDDADVHSSIHTRLRRRPQQHPHETTQTSTAASTRGRRRRPQQHPHETTQTSIAASTRGRRRRPQQHRGRRRRPQQHPHETT

SEQ ID NO: 786225 - protein, 66 aa, Homo sapiens
HIPPATSWFRKSGPSGKALPLPATSMSCPSLGPTSSTEPFLVTSAHSKVPSLDSLALTCTLLSRHQ

SEQ ID NO: 786226 - protein, 112 aa, Homo sapiens
ASQPRSSDDHRGHSLLLSTTRRPQSGALQHLASLPQRQESPSLVPKHTDSPPCPPSASSHETSPLTSWSWLPASLWLSFFSCPARKLGGLKPLLANSLPAPWPPGPSSPAGS

SEQ ID NO: 786227 - protein, 101 aa, Homo sapiens
SYVLSKLCKSNLNGKRLYFNKCELSEFAYQIKPNEFWTCFKFQARGPNSLHFTWRLARLSNKVLSRRQEILEKSNNVMTMFITFTVKPGCTSAQHQTLVRP

SEQ ID NO: 786228 - protein, 67 aa, Homo sapiens
GSTSERSSNTGREVPLPASVPDHTAPPLAGGRALAVSRTVWKAQKESSFEILLVIDTLLATLAIFRA

SEQ ID NO: 786229 - protein, 101 aa, Homo sapiens
MTYKSVDFCTFLKNGNTRFLDLTLPIRLTTLVLGVTTPIERPQSPPLPAARLPVFTQHDISMALETFEFATPGQASILYGAFTCYSYCFQECPYTVCVCSK

SEQ ID NO: 786230 - protein, 109 aa, Homo sapiens
PGRIDRIIYVPLPDAATRREIFKLQFHSMPVSNEVDLDELILQTDAYSGAEIVAVCREAALLALEEDIQANLIMKRHFTQALSTVTPRIPESLRRFYEDYQEKSGLHTL

SEQ ID NO: 786231 - protein, 91 aa, Homo sapiens
DNNIRESDGKHSYHWLISSKEATGVGSNHCNWITSNYPLGGAAMLQEVGQACGTHPCKTINTPGRLKCEVVKLGVNKQNKLTDSCSCWLRS

SEQ ID NO: 786232 - protein, 46 aa, Homo sapiens
IPLPPQLLDNDYTRSTPILHTAPRGIIRKCKSDHVISWLSTLQHTK

SEQ ID NO: 786233 - protein, 152 aa, Homo sapiens
RSPRARIRLPVGPVGSASLSHLRIWQSLAFAALRCRHMPSGNITPPHLRMQPSGPLWASVPACAPWKEHTFPNYLAASGLLRASASPFAGWRITARPHRSQWLVSGPRSPHLLSRQEHPFSRPLPRWVATAEQAATAQWKEDKPLWALGRRR

SEQ ID NO: 786234 - protein, 206 aa, Homo sapiens
DYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQI

SEQ ID NO: 786235 - protein, 50 aa, Homo sapiens
PLRPSSPPALEGRSVVCAPRYTSARFLAAMAWSRQNKTAIKTSQEVMTAS

SEQ ID NO: 786236 - protein, 35 aa, Homo sapiens
ITRLLLLRLGEQLSHLPTIMQQQSGNALILTQVSL

SEQ ID NO: 786237 - protein, 483 aa, Homo sapiens
RPRAQLRRAHLVPIPALAMTLAASSQRSQIIRSKFRSVLQLRIHRRNQEQNPVQAPISQQSSLAPWPALRHPGAPLSTQPCSSRPGLLPAGLSGSFTVSPVSDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 786238 - protein, 250 aa, Homo sapiens
RPRAQLRRAHLVPIPALAMTLAASSQRSQIIRSKFRSVLQLRIHRRNQEQNPVQAPISQQSSLAPWPALRHPGAPLSTQPCSSRPGLLPAGLSGSFTVSPVSDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRYDTHFCSPGTQKFRSQHPPPSNLESKIRGLGPPTLSSPRV

SEQ ID NO: 786239 - protein, 102 aa, Homo sapiens
TCFPPHLVWDQTSPICCSCTKALLNLLNSGILCQAARCRSNHSLCSGPNTPHQAALLPDAILTRVSLRYPDLVPLGSTHLVRMSPCSSPPNNYRTYGGKDER

SEQ ID NO: 786240 - protein, 219 aa, Homo sapiens
RGSRGSRHLLHGLGLQVLEGPWEDVGTPQKTRTNSVSLSKMQDAVLSWEHLLELKNNHCEQLTVNIKQMENMVGVLQKELCEAKETQLQLEHEKGQWEQERYSLRMTLKEEEKGRNADILPKKDSEQLKRKEKECGKEVETTTQTDSEITGHRIEDIRKEFGSGCAEAKRYPQQLSEEQNARILQDEILTSKHKEVEGAQKQMNSEISQSHGVNVRYRL

SEQ ID NO: 786241 - protein, 114 aa, Homo sapiens
MTLKEEEKGRNADILPKKDSEQLKRKEKECGKEVETTTQTDSEITGHRIEDIRKEFGSGCAEAKRYPQQLSEEQNARILQDEILTSKHKEVEGAQKQMNSEISQSHGVNVRYRL

SEQ ID NO: 786242 - protein, 102 aa, Homo sapiens
PVPQRHEVLPPHPMGQPSISYGFQFTNCRELRGQSFRYSECPARPSVWDNSVRPERFINLEKGIRSTATSNVPCAPCREHFIPGPGESTALKGLYPRHPGSH

SEQ ID NO: 786243 - protein, 48 aa, Homo sapiens
RKFKTSKMGHPSTATLLASSREGPTSNPSSETQSFSQHLPTTCTVLTG

SEQ ID NO: 786244 - protein, 109 aa, Homo sapiens
CSVAHASLSRALPRPGWDTLTLRTAVQEKLSMYSLMAGSGSCHCCSESGVEPQAALLLRPMPVFPILFPTHNCSLTFPTCFSQNKAYFLPSALTPTPHCLSWEEGFRES

SEQ ID NO: 786245 - protein, 41 aa, Homo sapiens
LSTLHLKFISLVAEERQNPSLISSALSLSPHHDVFPDQENN

SEQ ID NO: 786246 - protein, 38 aa, Homo sapiens
MGPGSVLHTGETGLANRTDGSLHSCGSSRAGQSERMRV

SEQ ID NO: 786247 - protein, 119 aa, Homo sapiens
MEVKACTILWKSKSARMCPKWTQVVPGTSRVPDQSTQSESLCLRLWGQKGQVDLVPEGNHVALTYVTSIEETCYLYCSGSPGSFAMLRPFLGPGQSAISSAHGNFMPQSTRSRTYQTSL

SEQ ID NO: 786248 - protein, 70 aa, Homo sapiens
DQDLPDAPGPPGERVVTFCDQFGKRLGGPATGQCGNPGFEFPPRRCFRTESPLNALPQVPWALVSPSVKQ

SEQ ID NO: 786249 - protein, 137 aa, Homo sapiens [sequence omitted]

SEQ ID NO: 786250 - protein, 416 aa, Homo sapiens [sequence omitted]

SEQ ID NO: 786251 - protein, 334 aa, Homo sapiens
LASSFISKWLKSFLKKLMISYLFSVLTKPPLTPQILCTKSENARLVVQIDNAKLAADDFRTKYQTELSLRQLVESDINGLRRILDELTLCKSDLEAQVESLKEELLCLKSNHEQEVNTLRCQLGDRLNVEVDAAPTVDLNRVLNETRSQYEALVETNRREVEQWFTTQTEELNKQVVSSSEQLQSYQAEIIELRRTVNALEIELQAQHNLRDSLENTLTESEARYSSQLSQVQSLITNVESQLAEIRSDLERQNQEYQVLLDVRARLECEINTYRSLLESEDCNLPSNPCATTNACSKPIGPCLSNPCTSCVPPAPCTPCAPRPRCGPCNSFVR

SEQ ID NO: 786252 - protein, 334 aa, Homo sapiens; identical to SEQ ID NO: 786251

SEQ ID NO: 786253 - protein, 32 aa, Homo sapiens
MPPWQRVESVRGVLPLLAHRGRLGAMKGVEQK

SEQ ID NO: 786254 - protein, 44 aa, Homo sapiens
LLVPVYAGLLVPVYAVPVTPKLQVWVCTALLPGHWASKLPMLGL

SEQ ID NO: 786255 - protein, 61 aa, Homo sapiens
LLGTGPSRAGGGSFLPLQPHAHSWSSSRFAQPRAWALNQGLILGSSESFCPERSLPRRLER

SEQ ID NO: 786256 - protein, 83 aa, Homo sapiens
DPAGSTLRPPQTVTYTCCLRLLMRTSESWTLHDLSYMVDTVLLMHSLLEKPSVSKWLHFSEPPLPFIKSEAIPPRSKGAAGTQ

SEQ ID NO: 786257 - protein, 226 aa, Homo sapiens
EDLDNNPKIQQALNIQQVLLEGVLCKVQEFCREHHWITGIYEFLQSWGPQKLEDMRGGPIKNYVTLVSRLNVWQARVSSMPIELLTKGGLLLLSCHDVQAEMESKLNSIRKDILAHVQNECWNLSQQLMTELTDFMHIFRTINSDIHAIAQCTQKLNEANEQYVELEERMEYVRALHELIRNHFSLFSAENEALDISVRRQFGESPIPPCPPPPQPHLLHCPLLAP

SEQ ID NO: 786258 - protein, 128 aa, Homo sapiens
MTELTDFMHIFRTINSDIHAIAQCTQKLNEANEQYVELEERMEYVRALHELIRNHFSLFSAENEALDISFSPAMAQEKTEGWLTEAARMSTTLELHSPVLQHCMRILGEFRSYLPLLTKLGSLHPQSL

SEQ ID NO: 786259 - protein, 127 aa, Homo sapiens
NPSASKIRQSSHRHGASSQQVQPAKARSLLAVLSQGPLQPWPQLAVPDRTVEFTLWSRGLKPAPISAPRCGQKGNESRSHAWLSMEPPMSGREGDSLQRSQARAALGAQDAADHAPSTADMRGRFHT

SEQ ID NO: 786260 - protein, 211 aa, Homo sapiens
GLHYFHSKIDPHFYCKQKLRTQDYNAAEDADRCVLLPVPLCGVDGGLCVARQGILRQNEQRWRWIFRSVIYEPYLAMFGQVPSDVDGKPDLAQMETAWRRHLLPEPTPRAAPETALQKHARETESNITEYQYDFAHCTFTGNESKPLCVELDEHNLPRFPEWITIPLVCIYMLSTNILLVNLLVAMFGYTVGTVQENNDQVWKFQRYFLVQ

SEQ ID NO: 786261 - protein, 41 aa, Homo sapiens
MGMKYLTCLRKREKFGVAAVEDFRESTATYEDGDESWAQIN

SEQ ID NO: 786262 - protein, 38 aa, Homo sapiens
YVCTVSSSGHSTKLRISFQLPPSAITGMLTFSTTRTFL

SEQ ID NO: 786263 - protein, 137 aa, Homo sapiens [sequence omitted]

SEQ ID NO: 786264 - protein, 148 aa, Homo sapiens
ARDWRPMNASINESVNKGKLRTLCVSPKECFNFRHRGHAVGMWTGMVLPVNYDLAQSSLSVMFANTVFKVPAASLQNCPLSCGHGHDDILFMNSCMIYLLSIYLWEHEICLFSPRVSDPWGAMGSCVQDQTFSGSICFPHQEGTSFHT

SEQ ID NO: 786265 - protein, 101 aa, Homo sapiens
GLAVLPRPVRAISCVSGPCVVGVLTYNSGSIHCNLDVGAAHWDPTQSSLLSQGVVFTQRHSADRKRALLSRHRLCPKTEELGRVWWLTPVIPALWEAKAGG

SEQ ID NO: 786266 - protein, 110 aa, Homo sapiens
YGLPSLKSLEVVSFRQAGSRGLIDIIRTRSLSLNLPSALLLCVGLTVRWDSSTWWCPDSLKFIPSWFKPRRKTNAPFQLFKQKSHKCISLDQIGSHATPEPLTVAVIVVH

SEQ ID NO: 786267 - protein, 141 aa, Homo sapiens
YFKLLNGETFLTKHCPLWPQCPSFGSPLAKHFQRSISSVLSPEPAQLPNHEFKYPTIQPHSPFPTHLFKCLLETQTTNSQILPTWPSLSASAPTGLTLFFFKFSLDSIMTTASFRITSSPLSLSEQQTNRTIYPQACAHTA

SEQ ID NO: 786268 - protein, 85 aa, Homo sapiens
FEQEGAVAGRRQPAQGDGEWPQSRRGPGVLGSGISMFGNHLVSAQRGPSGTAHYGADQSTHPGPEALEVANVMYSNDGGLFPDRC

SEQ ID NO: 786269 - protein, 175 aa, Homo sapiens
AWAPRGFPAGSLSPSSARPGPPWQARGARGGQRRRPPPGTERNPRPALPRPARVGLSQAPQHGDPRAGLHAAEPLQVRLWPTDTACSRQRMWEPRGNPPDLSTEVTAAMTFPREFHLCVFPSRYLFEHLLQGPSSTSIGMFQKSTAVLSPDSSLHLILSQALGPSEWCHSKSETR

SEQ ID NO: 786270 - protein, 114 aa, Homo sapiens
LNVAGAQDAVAMTIIIIHVSRTDLPNSSNSETAGRMESVTGKRFKGEHEREAKILLHSAQETGNSQFLRIWGRQSRLPVIQVSRSTEIPTNSDSSSTLDLEFQEIKVHPVLLLK

SEQ ID NO: 786271 - protein, 117 aa, Homo sapiens
SWSETGWWVTCVFGCSLPDHLSCSRDGAKKISLTEHNFTCLFSSQTRLLKLHYYPLSALLYACERQRNYLFFKLRCLTRGKHLPFGECGAAPHFMQSHLGFLELSPALSPPAGTKHT

SEQ ID NO: 786272 - protein, 717 aa, Homo sapiens
MHGAARAPATSVSADCCIPAGLRLGPVPGTFKLGKYLSDRREPGPKKKVLTIQTSAHQVRMVRGELVDESGGSPLEWIGLIRAARNSQEQTLEAIADLPGGQIFYRALRDVQPGEELTVWYSNSLAQWFDIPTTATPTHDEKGEERYICWYCWRTFRYPNSLKAHLRFHCVFSGGGGGAFLHHEHAARQGAVPAADGLGLSPKPPAPDFAAPSQAGTLRPHPLGPPPVQACGAREGIKREASSAPSATSPTPGKWGQPKKGKEQLDRALDMSGAARGQGHFLGIVGGSSAGVGSLAFYPGVRSAFKPAGLARAAAAAHGDPYREESSSKQGAGLALGRLLGGGRACGRPGSGENSAAGGAGHHHHHHAHHHHHPKCLLAGDPPPPPPPGLPCSGALRGFPLLSVPPEEASAFKHVERAPPAAAALPGARYAQLPPAPGLPLERCALPPLDPGGLKAYPGGECSHLPAVMPAFTVYNGELLYGSPATTAYYPLKLHFGGLLKYPESISYFSGPAAAALSPAELGSLASIDREIAMHNQQLSEMAAGKGRGRLDSGTLPPAVAAAGGTGGGGSGGSGAGKPKTGHLCLYCGKLYSRKYGLKIHMRTHTGYKPLKCKVCLRPFGDPSNLNKHIRLHAEGNTPYRCEFCGKVLVRRRDLERHVKSRHPGQSLLAKAGDGPGAEPGYPPEPGDPKSDDSDVDVCFTDDQSDPEVGGGGERDL

SEQ ID NO: 786273 - protein, 309 aa, Homo sapiens
MPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSLIVEGVWSFSHQAQHNFCGYFSAPVCHQHHLGFQLTWELQV

SEQ ID NO: 786274 - protein, 47 aa, Homo sapiens
QRPPCRGTGPEGRACSDLQCSGVSGSGFLAELCCCVTGLYVSTSLEG

SEQ ID NO: 786275 - protein, 71 aa, Homo sapiens
LSRKLTSRMGDENVRSFPPCLSPSRGFIMTLQEALLQGSAYLKPFSPAMLCALQFTKRFSPLLSFNFRKII

SEQ ID NO: 786276 - protein, 208 aa, Homo sapiens
WLVFSIRRQLWQNYNILSCTGVGIRFENYLGVELLGYVISVCLTLLEMAKLLSKVTVLHFQLQSMRVPNFPLSLQLSVGGSSQGNRQEKEIKGIQFGREEVKLSLFVDYNIVYLENTIVSAQNLLKLIGSFSSVSGNKISVQKSQAFLYTNNRQTESQTMSEPPFTIATKRIKYLGIQFTRDVKDFFRENYKPLLNEITEDTDKWKNI

SEQ ID NO: 786277 - protein, 51 aa, Homo sapiens
MSKAHPPELKKFMDKKLSLKLNGGRHVQGILRGFDPFMNLVIDECVEMATS

SEQ ID NO: 786278 - protein, 152 aa, Homo sapiens
GKFIALNAYKRKQERSKIDTLTSQLKELEKQEPTHSKASRRQEITKIRAELKEIDTKTLPKTNESRSWFFERINKIDRPLARLIKKKREKNQIDTIKNDKGDITTDPTTDAFTYQRPHLLIPSRFGLEFQHTPLAGTQRMVHNSRYLTMFLL

SEQ ID NO: 786279 - protein, 49 aa, Homo sapiens
MSTKIKLASKRGPNFVKELKTSPQEWLETHPGCGAGPAYDLIFVSATPL

SEQ ID NO: 786280 - protein, 142 aa, Homo sapiens
GSERWLQEGAGILSVGKDKVGRLHGEGEKDERRLIHITGTETSQVGTGSSLFLPYPRKPGLNGGCFCLPLRPSYRFPSRHCHLPWVTEARGSPLRKLGNARLLGKASQSQPVTAALSLGPSRGKRLGQESPEGSELALGQKA

SEQ ID NO: 786281 - protein, 35 aa, Homo sapiens
DSTGTHSLYTTYKDYELMFHVSTLLPYMPNNRQQV

SEQ ID NO: 786282 - protein, 77 aa, Homo sapiens
AAGEASGSLAPPEPAAARRLCPQASGARRLGPARQVPAWGTGAASVGGGLRTGRKLEKRCPLNLCVWLPRLALTPNG

SEQ ID NO: 786283 - protein, 77 aa, Homo sapiens; identical to SEQ ID NO: 786282

SEQ ID NO: 786284 - protein, 77 aa, Homo sapiens; identical to SEQ ID NO: 786282

SEQ ID NO: 786285 - protein, 77 aa, Homo sapiens; identical to SEQ ID NO: 786282

SEQ ID NO: 786286 - protein, 80 aa, Homo sapiens
MTRRGSPKKSAGDGRLDNQGARHRPTQTKSGHPPAGIKKRTKKKKTDTHTAHDRPHKKQTGRQKRGKQTELQDKPARLLT

SEQ ID NO: 786287 - protein, 105 aa, Homo sapiens
MEMLQGLLLLLTAEHGQGAHGAYNGKTSIRRNACQSPNSNGHTRDIAERNRQGNDTTKTQSNTDNESTKQDHETNRNHKHGKQRWQTKDGPLDEPPYPHGEKLNT

SEQ ID NO: 786288 - protein, 112 aa, Homo sapiens
QPLRQSEILSPKKKKKKATEANESAWEWSLWGIPVRVTQVMSLPKPWSLLPPAGLVNYHISVKCSNQFKLEVCLLKSDNKVVDNQAGTQGQLKVLGANLWWPYLMHEHHARR

SEQ ID NO: 786289 - protein, 193 aa, Homo sapiens
MSLPKPWSLLPPAGLVNYHISVKCSNQFKLEVCLLKSDNKVVDNQAGTQGQLKVLGANLWWPYLMHEHPAYLYSWEDGDCSHQSLGPLPACDLCDQLHLRSRQGGSVSQYDLCGLASTLGIRMQVDLERIHSLWAAQFENWCKTSQSHYSERVWSGNACRVSPGLVNYRISVKCSNQFKLEVVFEMQKTKPWR

SEQ ID NO: 786290 - protein, 84 aa, Homo sapiens
MRRNAQRPFMTQSRGAGCGQRPLHIHPQQTTACRPTRWATLHDTRDQSTTTPRRPRAPPNTRLHYSGPPRPPDTQLHQPTRPVA

SEQ ID NO: 786291 - protein, 135 aa, Homo sapiens
SLTTALKPARSGWWLLSSASMGLGGQRGQGAIRASPPPIHCASVLALGQGVGLGCGHRLPLSMVNGTPGYPECKQDQSPQPSWLCPGHLLLLALLSARIAGSPWKVPHMLLSPSCGMCHFLCLPLPNPYFFFWSA

SEQ ID NO: 786292 - protein, 110 aa, Homo sapiens
MFQLQTKALIKTLQPQEMNVQVPQEAGRLGWKRNESTRPSVNKFKILAPLGMDCQYSLPMKTMVDFHNFFSYNLRGCQWPTSVPLKSHVCFTRAKENDSLMRTRFALSEM

SEQ ID NO: 786293 - protein, 71 aa, Homo sapiens
TSNSINYYSINYYSINYYSINYYSINYYSINYYSINYYSINYYSINYYSINYYSINYGNLLDFQQHKLLVE

SEQ ID NO: 786294 - protein, 113 aa, Homo sapiens [sequence omitted]

SEQ ID NO: 786295 - protein, 72 aa, Homo sapiens
FLTVAVVLQIFKDALSWSSLLPPFLSEKTPPRDKCARRHGCLAFCTVWGNLCKFLYFCFSFPCEIKSKPKRP

SEQ ID NO: 786296 - protein, 89 aa, Homo sapiens
ALTLVSHLAEVWLAVSENVPFARTMLHSLMGRLQSRLSPRISATSKADIWRLAAVDPLMTLCTIHLLIQKLDENDKLPDFLPDLIYTLL

SEQ ID NO: 786297 - protein, 73 aa, Homo sapiens
VIRRVGVTTLLKESEGEARNDAPSMLPEISGCLDPQVAVDKSVELGSHGLKLLGSRDPPALQSLEIMGMSQHT

SEQ ID NO: 786298 - protein, 36 aa, Homo sapiens
QGKQYSIINLLGGIADVLPFSLTLASGEFGIIAPVC

SEQ ID NO: 786299 - protein, 81 aa, Homo sapiens
LQIYAAIKNDESCPCRDMDEMETIILSKLSQEQKTKHRIFSLIGGNGTMRSHGHSIPVLCGHVKNLNMNNEHEQYKKHNIE

SEQ ID NO: 786300 - protein, 361 aa, Homo sapiens
RGLLGVHARPAPPGPERSLPAARPRLVLSGTMMWGAGSPLAWLSAGSGNVNVSSVGPAEGPTGPAAPLPSPKAWDVVLCISGTLVSCENALVVAIIVGTPAFRAPMFLLVGSLAVADLLAGLGLVLHFAAVFCIGSAEMSLVLVGVLAMAFTASIGSLLAITVDRYLSLYNALTYYSETTVTRTYVMLALVWGGALGLGLLPVLAWNCLDGLTTCGVVYPLSKNHLVVLAIAFFMVFGIMLQLYAQICRIVCRHAQQIALQRHLLPASHYVATRKGIATLAVVLGAFAACWLPFTVYCLLGDAHSPPLYTYLTLLPATYNSMINPIIYAFRNQDVQKVLWAVCCCCSSSKIPFRSRSPSDV

SEQ ID NO: 786301 - protein, 76 aa, Homo sapiens
YPSTSPQVVSQTGVSRYSQESENSLRYKQFCGSLCRCKHHTSGVYWRVELKMIIVKQCQNLSETFASSKFEQLVCN

SEQ ID NO: 786302 - protein, 789 aa, Homo sapiens [sequence omitted]

SEQ ID NO: 786303 - protein, 104 aa, Homo sapiens
SPCVQQEEVDSTQEGRSHLIHPRTPEECSLQEAPGLIALGLNPCRSPRSSVSLPSLFIPLHPFLDLRTHSYHPPSLPLFSHFPSLLSHHLSSLCLLYSITPLQR

SEQ ID NO: 786304 - protein, 115 aa, Homo sapiens
CCVRYAMKRHKKALFVMFHRQCLASTHKPSLKLRAFVSNSKTPNDGAYLHRPLALCRGEGLGNPASHAHEDAPLILIDIESMLEDLSCVSDSTINSVCDLWCNPSFVAPHFSKSR

SEQ ID NO: 786305 - protein, 97 aa, Homo sapiens
LEDPISTTIQATLGSWYECITTLKRNQSFCPTVNLYKLWTVLREQTRVNASVEVATSTDAFTQDSRTSPQQANNVLGVVKYLPFCKVTFVVQLQSWC

SEQ ID NO: 786306 - protein, 163 aa, Homo sapiens
QEPAGDSESTGDWDHFEPLLSSLLRRMPELETLEIMKLVNCPETFASDMRCIMGESPAVEGYFVLAGMNSAGLSFGGGAGKYLAEWMVHGYPSENVWELDLKRFGALQSSRTFLRHRVMEVMPLMYDLKVPHWDFQTGRQLRTSPLYDRLDAQGARWMEKHGF

SEQ ID NO: 786307 - protein, 66 aa, Homo sapiens
GIDYNSINYYSINYYSINYYSINYYSINYDSINYYSINYYSINYYSINHGSPEGFHSLYCEYSIIY

SEQ ID NO: 786308 - protein, 102 aa, Homo sapiens
QWRHLGSPQPPPPGFKRFSCLSLLSSWDYRHVPQRLANFVFLVETGFLHVGQGGLELPTSDDPPTSASQSAGITGVSHHARRKVFKCLSNTLNFVIGLSTEN

SEQ ID NO: 786309 - protein, 38 aa, Homo sapiens
MVGMDAPNDPESRTSKQIKWQHRPPNSHATLKLETNSP

SEQ ID NO: 786310 - protein, 88 aa, Homo sapiens
HHHDPDLQPTFNVVVKSWWVDDGPRFQGKVAWSVSSLGTSEWESWAYRYVDLLQTVGTDQAAPDFCPDSPVLGALENKTLTRAKDDHD

SEQ ID NO: 786311 - protein, 123 aa, Homo sapiens
SSFPFVYLLLHVPKRNVNFHILKKTLEENLGNTIQHIGMGKDFMSKTPKAMATKAKIDKWDLIKLKSFCTAKETTITVNRQPTEWEKIFAIYSSDKGLISRIYNELQQKRKKQTTPSKSGQRT

SEQ ID NO: 786312 - protein, 115 aa, Homo sapiens
MDVDRREVGVQDYLQTLADVPRQAVGSFTEKIKHWIGCGKIKSSVLKVLSERDKWRCQVSNCMYQCETQKEGLPASFQLKKEYLFLKENFEVETCLHFLGYFSNKPTYFHNRVIR

SEQ ID NO: 786313 - protein, 56 aa, Homo sapiens
TKAARKSVPSTGGVKKPHRYRPGTVALREIRCYQKSTELLIRKLPFQRLVREIAQD

SEQ ID NO: 786314 - protein, 70 aa, Homo sapiens
AFSLHFLPKSTRNGHSWLPSGLLGRLNSLTELSDSLKNMLRGPDFMTKFIYPGSEKTPNRVFFFPALCEV

SEQ ID NO: 786315 - protein, 76 aa, Homo sapiens
PYKIPGPLQCMQAPRYSSGRRKPSQTFPVMKLLTTHLKPTEIPQYRHRCPKYNAPNMLRAPTYVSLDTTTKSIETF

SEQ ID NO: 786316 - protein, 90 aa, Homo sapiens
MRPASPAALRAASPMHTVLAAMCITPHDGTQALGRAQAFGGRADLLLPCLCLISPSETNDTARFPRMVPSLSVASADRGPPSWAAGIGAG

SEQ ID NO: 786317 - protein, 43 aa, Homo sapiens
MEPPTNHMHWLPRWLHSGDHVSVLSSFTHWFTTITLEFWTKEV

SEQ ID NO: 786318 - protein, 305 aa, Homo sapiens
RARKRGGAALGMAEPDLECEQIRLKCIPGTMPECEGVEKLNRIGEGTYGIVYRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGITKAATGRPVQPPGSSLQQPEGTSPMGGGSRAFALAGTIWLM

SEQ ID NO: 786319 - protein, 294 aa, Homo sapiens
RARKRGGAALGMAEPDLECEQIRLKCIRKEGFFTVPPGTQDRARDTQTDEIVALKKVRMDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGITKAATGRPVQPPGSSLQQPEGTSPMGGGSRAFALAGTIWLM

SEQ ID NO: 786320 - protein, 121 aa, Homo sapiens
LSTALALVGKPDILLLDEPSSGMDPCSKRYLWQTIMKEVREGCAAVLTSHSMEECEALCTRLAIMVNGSFRFTFHQLSKHHPLPARKTLFPHAPSRCLRPSSGLTDSVSQCPRPGEWNTLT

SEQ ID NO: 786321 - protein, 164 aa, Homo sapiens
LSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQV

SEQ ID NO: 786322 - protein, 79 aa, Homo sapiens
AATGNALLQFQGGVHQVVDVGCILQVLREVLVDLHGLHSRLLRVAYRTTGWSSRLSSWPCQAGGDSSAIRRLRRDAMLI

SEQ ID NO: 786323 - protein, 49 aa, Homo sapiens
PQRRQQMAGGHPSLQKPLCSGPACPDLPPCPGRGPPGSRPPCEAHLLAT

SEQ ID NO: 786324 - protein, 236 aa, Homo sapiens
EWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLNQTKASSALIQESLKESYKLQISLDQERDAYLPLAESASKMYFIISDLSKINNMYRFSLAAFL

SEQ ID NO: 786325 - protein, 216 aa, Homo sapiens
EWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLIDIMNGCYLPCSARHVRHLIVIHDPLVGCFLTFHESTTTRSEI

SEQ ID NO: 786326 - protein, 114 aa, Homo sapiens
AGVSHRTQPILNNFLAHSYIFLCQECSSSPSANLGCFYLSFRTQSKWHPQRSLALYSISWQLVFLFSSTYFSLQLCIYLCDYLSHALIPSALLLLRTRSDSCSSVAAPYLVTGT

SEQ ID NO: 786327 - protein, 327 aa, Homo sapiens
VELVASTKNTFQSQEKLIKEMDYLWKINQETRNNLNQETSKFCSLVDYVSLRKRIITIQYQKMHLFLNEEEQLHLQALEREAKELFQQLQDSQVRMTQHLERMKDMYRELWETCHMPDVELLQVRREVFARTDLAQMQKPQPVNPELTSWCITGVLDMLNNFRVDNALSTEMTPCYISLSEDVRYVIFGDDHLSAPTDPQGVDSFAVWGAQAFTSGKHYWEVDVTLSSNWILGVCRDSRTADTNIIIDSDERFFLISSKRSNHYSLSTNSPPLIQYVQRPLGRVGVFLDYDNGSVSFFDVSKGSLIYGFPPSSFSSPLRPFFCFGCT

SEQ ID NO: 786328 - protein, 53 aa, Homo sapiens
MGHRLKSGTPKDGGGRQGSEKSCFQWCAGCFVSQAHKRGTSFNRPFHDTVGEL

SEQ ID NO: 786329 - protein, 77 aa, Homo sapiens
PKLLPSMALPSPKRVMLVCTQSAGKGKSGGSCRGAFGTKPGMLPTSVHSPQAGVQHQIGASVTREKLGAKSGNFQEH

SEQ ID NO: 786330 - protein, 121 aa, Homo sapiens [sequence omitted]

SEQ ID NO: 786331 - protein, 84 aa, Homo sapiens
FLWEELTRCVLCAKDHSKQRLSKHEECLCTGQLHVPQDHLGCTISLSTAWHSGIPVCATRAWLVKSLSPTPPGAPRGKGFTLFI

SEQ ID NO: 786332 - protein, 106 aa, Homo sapiens
SQAFQGPWRPARAVDFSQEPLTHAHLQRPPGVKKTAFPPVSSRAGCIQEDSAAGEWFGFVSDHSKKSSRTTSARLAVQLSPLEPLGNTASVSSPQSSCVRLPDGGA

SEQ ID NO: 786333 - protein, 132 aa, Homo sapiens
MTKPQAESGEAARHPIFRPARRVFGIKMTTLQPRIKAPQELTVLQERSRPTSKKMAVCFHGSSLRSEATPRYSLEEEARNEEMATSPVMVASLNKLPFWHPSPYARGGGTVLYPAWALAPALSSLLLCLPCF

SEQ ID NO: 786334 - protein, 81 aa, Homo sapiens
LFEAVGQSSRSMSEGEVHQTGVNQKQDEGHRDELTAFTKPWQLVRNGPRDQAWRNSTEGVCVCVCVCMCICVCVYICKNQP

SEQ ID NO: 786335 - protein, 37 aa, Homo sapiens
SQPLQTKLMTLNGLFRPIPYVTAASADEATPHNSLHR

SEQ ID NO: 786336 - protein, 105 aa, Homo sapiens
WEAEHEPYLGSGLQECMYSWSSTAAWVGMLPSSRPGHSGESRPLGRASGNRTLRTLHGMSVMAGSLLLYAKRGPVLAVGQLSSWPVVCLRLLCLALSSSSVGRFS

SEQ ID NO: 786337 - protein, 135 aa, Homo sapiens
MKRVTGCILSNVNTPSMTPVIGQPQNETPQPIYQNSNVATKPTAAKILGKVGESLSRICCVRPPVERFTFVDENANLGTVMRYEEIGEWDCESAENGDIWSSLPSRQATWGAERLENPGTVLQQGLLSEEGSFPG

SEQ ID NO: 786338 - protein, 260 aa, Homo sapiens
HNETQKERQPLDHREGPICTMTETTKTHVILLACGSFNPITKGHIQMFERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIGEWDCESAENGDIWSSLPSRQATWGAERLENPGTVLQQGLLSEEGSFPG

SEQ ID NO: 786339 - protein, 235 aa, Homo sapiens
MEIQELEEIQACQGLWEVFVTLSERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIGEWDCESAENGDIWSSLPSRQATWGAERLENPGTVLQQGLLSEEGSFPG

SEQ ID NO: 786340 - protein, 188 aa, Homo sapiens
MRVLHQGKPGAGHSGCGSPHNKKGPGETRWVSENNLKRRIRERHMQGGPPQRGVPRGDGQILKINAPARGKKDRTKDDEDDARGQRRRKREGGEGGTRWRERSGEATSNDRKETAEDDRRTSRDGDRDGGGGRESAKREESRAGGERKGRAERRRRTGREAQEQGELRNRAEEQKSPEREGRRREKTA

SEQ ID NO: 786341 - protein, 35 aa, Homo sapiens
MSLPLSATTDLPRHHVPFQWGHRHNLSIKKNKYIL

SEQ ID NO: 786342 - protein, 66 aa, Homo sapiens
SPSILPILSFPEPVPLNACYKMPKTIHGHYGVHKYVTQILDTPFRRENLIPLSWSVAGLNYFASNE

SEQ ID NO: 786343 - protein, 65 aa, Homo sapiens
MALWTRFLSTETRILAEEDEQCTMIEQGEQCARESTQGMTLAYDQDHVEDTAHPVVQHGSGANSN

SEQ ID NO: 786344 - protein, 51 aa, Homo sapiens
MCSDSETSSAGSSREVGHQARLSWLQRKAPRNPAAEKMRLHGELDVNFNPQ

SEQ ID NO: 786345 - protein, 49 aa, Homo sapiens
QGTAYFLPDFLIPPVAKGPFPAAFAFSSSSFFCSSFCFCLKALSSSSIS

SEQ ID NO: 786346 - protein, 132 aa, Homo sapiens
DSLILPHTPPRHPAALKRLFFLSQPHAVAIPGSCGRRLLCAWVCPPGRLQPLVYKRCRWLKHKRVTSGSVFKSLFYPLHQLCLLGWTLENRFEPNGSLEKWRSSSGLSDYCNAALITKNLDLATQKKKKKRK

SEQ ID NO: 786347 - protein, 161 aa, Homo sapiens
PAALGAEEAVGEREERVPPWQCREFQLESASPLLHCHRQWSPCGKGQKEAEAQRGTMDLCVIDLPMATRSGGTLVLVGLGSEMTTVPLLHAAIREVDIKGVFRYCNTWPVAISMLASKSVNVKPLVTHRFPLEKALEAFETFKKGLGLKIMLKCDPSDQNL

SEQ ID NO: 786348 - protein, 122 aa, Homo sapiens [sequence omitted]

SEQ ID NO: 786349 - protein, 552 aa, Homo sapiens
SGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPGPMRSWTLPSDSPSVEDMRYLTRSLRRALDMTQPLRAKQTMIPSLHMSRKLSLWLERTPCMHKCSTYRERPQFLRRKRAQPQSTAPYGNLRWCHHHNRMILRFLKVLPMKISPERKSSCCLSPGTVGLESQLDLMGPGAHRQKHLRISFSASEMPGCGPSPSFSPLRTPKPINSSDTGSFLEPMGFRCLCPICHLAHL

SEQ ID NO: 786350 - protein, 642 aa, Homo sapiens
SGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSGEAVKITPYSHAHAATLSAGVPSSFLSENICSGPERNTKLWIGLFLMVCLLCVGIFSWCIWKRKGRCSVPAFCSSQAEAPADTPGPMRSWTLPSDSPSVEDMRYLTRSLRRALDMTQPLRAKQTMIPSLHMSRKLSLWLERTPCMHKCSTYRERPQFLRRKRAQPQSTAPYGNLRWCHHHNRMILRFLKVLPMKISPERKSSCCLSPGTVGLESQLDLMGPGAHRQKHLRISFSASEMPGCGPSPSFSPLRTPKPINSSDTGSFLEPMGFRCLCPICHLAHL

SEQ ID NO: 786351 - protein, 115 aa, Homo sapiens
MAPAPHPPRDRELFPTAAKMEKMQPAHGPAHMVLGALPACHLRATLDSSSTSLHVYCSHPGQPFVTLPLPAALALFLPTCHFTAQLELPLSWQVLPPVLSACLAFLAPLFPCIEP

SEQ ID NO: 786352 - protein, 162 aa, Homo sapiens
CVVSVAGPGAAVGRVAPRARGPGLLHCSALRQVAGIFLGGGHCCPFELCPFCTSSTPRPALTQVCGPPCAALRSAARGRWWCWSSVLASTLRLPLSEGCCSATGTGGRAASLGVSLPTWSRRTLSRDAPTLGLRTLGPLSRQARGTAGRSRRAQPNPKTAVI

SEQ ID NO: 786353 - protein, 686 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSVRYYLQSPGPQGSELAAPCSLFPYQAAAGAPHGPVYPAPNGARYPYGSMLPPGGFPAAACPPGRAQFGPGAGAGSGAGGINGGGGGPGTYQYSQGAPLYGPYPGAAAAGSCGGLGGLGVPSSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 786354 - protein, 705 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSVRYYLQSPGPQGSELAAPCSLFPYQAAAGAPHGPVYPAPNGARYPYGSMLPPGGFPAAACPPGRAQFGPGAGAGSGAGGINGGGGGPGTYQYSQGAPLYGPYPGAAAAGSCGGLGGLGVPSSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 786355 - protein, 36 aa, Homo sapiens
MHEPPSLALAFLSLKGRAGQARRLRQAEAGEWREPG

SEQ ID NO: 786356 - protein, 81 aa, Homo sapiens
VTLQLLGSQLCLVVTIVVQTENIFIIAECSVGQCYPKVLVSLSSRPHGPRSMHVCLYPSMLRSSMCVALRSARGKGPCLPP

SEQ ID NO: 786357 - protein, 209 aa, Homo sapiens
MELVTFRDVAIEFSPEEWKCLDPAQQNLYRDVMLENYRNLVSLGFVISNPDLVTCLEQIKEPCNLKIHETAAKPPAICSPFSQDLSPVQGIEDSFHKLILKRYEKAVDTENLQLTNNGRKRVNDVSGAEQDVHYWSLPVLVNYPGANTISLVIHVLQFPSTFSNSNKHNDNDILDEKPFYTVQNCGQTRLTWSHLNFNHTANSMPGGRN

SEQ ID NO: 786358 - protein, 138 aa, Homo sapiens [sequence omitted]

SEQ ID NO: 786359 - protein, 355 aa, Homo sapiens
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGRVWFGVYI

SEQ ID NO: 786360 - protein, 351 aa, Homo sapiens
MGNLFMLWAALGICCAAFSASAWSVNNFLITGPKAYLTYTTSVALGAQSGIEECKFQFAWERWNCPENALQLSTHNRLRSATRETSFIHAISSAGVMYIITKNCSMGDFENCGCDGSNNGKTGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSAQSLGKGSA

SEQ ID NO: 786361 - protein, 104 aa, Homo sapiens
MCYRLLRVYRFLGTDMGGWLGHRWAIDFCPLSLSLFICKTGLVALGGLHVAPCKTSLVALAGLHVVLCLAHGRHSGNKGRGVHAALTTGGSQDCFPALLSLDEK

SEQ ID NO: 786362 - protein, 154 aa, Homo sapiens
LWDFGWLTHTSTQAIRSQNDPILRVKGGNSHRGFSQPLFPGKINPTEREAGPEALQRGPIYRERAQNQGWASQKNNSKIVAETATVMNAGGKQEAGRLGPVGFRLEDWGAAGKERSTEGTVEDNWTGMPQSNCGMLDWDLGEERATCRDASLIL

SEQ ID NO: 786363 - protein, 293 aa, Homo sapiens
PPAPKKKMDLEQIWQLLMTADRKDYEKICLKYGIVDYRGMLRRLQEMKKEQEDKMRQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKELQSTSADHKLQRQGAQASGAEESGSIESQGEKSRALRPEPSPAHT

SEQ ID NO: 786364 - protein, 487 aa, Homo sapiens
PPAPKKKMDLEQIWQLLMTADRKDYEKICLKYGIVDYRGMLRRLQEMKKEQEDKMRQYINTISSLRHIRVTKDGNAKFDLELDLKDSQSKIYLYKDGEMIPYGFNNQTKHCLRRLGKRYEFQIQDLRPEDSGIYQVKVEDAVVFSTELEASAIPPRVVVPLAETHCEEQGDAVFECTLSSPCPSAAWHFRHRLLHPSDKYEVYVSPDGLTHRLVVRGARFSDMGPYSLGTGLYTSSAWLVVEAGKDKELQSTSADHKLQRQGAQASGAEESGSIESQGEKSREQGPRGGSLEGAGPASGLQHIASPDRDGLGRHGYSLMGDKGTADSAWGPGQEGEGFPVAEGSRATLPRENQSHREGGWARSLAERPHLQGESSESGLGLPEKQQQDRGRDSNSDECWRKAGGWEAGSSRLQAGGLGSSREGKEHRGDSGRQLDRHAPEQLWDARLGPGRGKSDLQGCQSDPVGSWPRGKQIEISQDDSLAEMDRE

SEQ ID NO: 786365 - protein, 71 aa, Homo sapiens
GGHSSTQYLHQLKLALPTLDSRCGDAPGRRSSRCLWLSMWVCSLSFSHSQKLRWTNYEPVLHPKRWDGRIF

SEQ ID NO: 786366 - protein, 209 aa, Homo sapiens
MGEILNEIDSINKKSKFQETIDTLIEMLNVLESLSNRIQQAEERTSELEDKFFELTKSNKDKEERIRKIEQSLHEVWVHVKLPTLRIIGIPEEEEEPRSLENIFGRKIEENFPSLARDLGIQIQEAQRTPGKFIAQRSSPRHIVIRLPKVKMKERILRTVSQKRQETYKGKPIRLTADFSAEILQARRHWGPIFSLLKQNNYQPRICIQ

SEQ ID NO: 786367 - protein, 84 aa, Homo sapiens
TVPVQCSSRSSVEQPVLAWAVLLRGTLAMAEDIVVSRLGEAPGMEWVEARDAAQYPAVPRMAPRQRMIRPRCPQRPEDPGLARA

SEQ ID NO: 786368 - protein, 55 aa, Homo sapiens
PATTFQPHASQPPPSHVPPSHTPPTTTFQPRASQPPPPSHTPPSHAPPTTYNLPF

SEQ ID NO: 786369 - protein, 186 aa, Homo sapiens
MAPERHNDKYSCVNSILNSSELPQERADILCDVTLRVEQNRASLPIGLCWLAVSDYFCAMFTSELSEKGKPYVDIQGLTASTMEILLDFVYTETVHVTVENVQELLPAACLLQLKGVKQACCEFLESQLDPSNCLGIRGFGGTHNCVDLMQAAEVFSQKHFLKWYSDEEFILLSQGEVEKLIKCDE

SEQ ID NO: 786370 - protein, 82 aa, Homo sapiens
SPRFTGDSSHSDARSITEVRENMRAHSGLCKMGQSQSGGHGPGGGKKDDKTRKRNMNLLYQLQWGKRRRKQRDQMLPANCHW

SEQ ID NO: 786371 - protein, 240 aa, Homo sapiens
MSRSRHLGKIRKRLEDVKSQWVRPARADFSDNESARLATDALLDGGSEAYWRVLSQEGEVDFLSSVEAQYIQAQARSPRVPQTPWEGRKQALKGLDSSSLQSGTYFPVASEGSEPALLHSWASAEKPYLKEKSSATVYFQTVKHNNIRDLVRRCITRTSQNISIRSVEGEIYCAKSGRKFAGQIREKFIISDWRFVLSGSYRLHLALQDTLHRNILSKFTGQAVELFDEVFRHLYASANM

SEQ ID NO: 786372 - protein, 295 aa, Homo sapiens
MSRSRHLGKIRKRLEDVKSQWVRPARADFSDNESARLATDALLDGGSEAYWRVLSQEGEVDFLSSVEAQYIQAQARSPRVPQTPWEGRKQALKGLDSSSLQSGTYFPVASEGSEPALLHSWASAEKPYLKEKSSATVYFQTVKHNNIRDLVRRCITRTSQVLVILMDVFTDVEIFCDILEAANKRGVSCVLLDQGGVKLFQEMCDKVQISDSHLKNISIRSVEGEIYCAKSGRKFAGQIREKFIISDWRFVLSGSYRLHLALQDTLHRNILSKFTGQAVELFDEVFRHLYASANM

SEQ ID NO: 786373 - protein, 193 aa, Homo sapiens
MFELFNVPGFYIAVQEVLALEVSWTSQQVGEYMLMSIVIDKGDGVTLVLPVVEGYVIGSCINHILIVGDTVYFIQQLLREREVGIPLEQSLENTKAIKEKYCYICPDIVKEFAKYDVDPWKWIKQYTGINVINQEKFIIDVGYKRFLQPEIFFYPEFANPDFMESILNVVDEYKTVPLMRIVHCIRMLFFQGV

SEQ ID NO: 786374 - protein, 95 aa, Homo sapiens
ETAWPGAPRRVVALTLTIAIQGAGRVARPAPLGMRTHLCAVGWLGPEELPPVCSTERSKSLGQIPWSSCGSTVQGIEEGNTSSDHKTKLKNYKTI

SEQ ID NO: 786375 - protein, 81 aa, Homo sapiens
MEQVLCPNVEPSQAPARLRLSRWASTVQCRGLEQLQEIRVASPQDPEPPSPAFLMQGREGKELLGTRLTRVLCSDIQENAT

SEQ ID NO: 786376 - protein, 60 aa, Homo sapiens
MTTVGNRRQGYGQDGPGNPGNPRPSWHLAGDTKLRCWGNCLRGSPPLMNDSSAALVAPPP

SEQ ID NO: 786377 - protein, 32 aa, Homo sapiens
MAPCCRVLTWQQEEEPSRRRIAQEERMGSLDT

SEQ ID NO: 786378 - protein, 123 aa, Homo sapiens
MPPCLALSFFFFFFFDSKVLDGVWLQLADMRLPRPARPKATELTPLAVSGEQCSVSPDAEWERPISSRVLQAGVLVSWAGGWEQCPVVPEWEGPAVASTGCFCFLERVVFLPMRARDSTHGHT

SEQ ID NO: 786379 - protein, 66 aa, Homo sapiens
YHPHPPSARCPSECGLQRSGGRTCAAAAFQRVAQTGHPFPFPQPRNSEMDIIPPSRIMGIKLEVNF

SEQ ID NO: 786380 - protein, 97 aa, Homo sapiens
LLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIF

SEQ ID NO: 786381 - protein, 193 aa, Homo sapiens
MFELFNVPGFYIAVQEVLALEVSWTSQQVGEYMLMSIVIDKGDGVTLVLPVVEGYVIGSCINHILIVGDTVYFIQQLLREREVGIPLEQSLETTKAIKEKYCYICPDIVKEFAKYDVDPWKWIKQYTGINVINQEKFIIDVGYKRFLQPEIFFYPEFANPDFMESVLNVVDEYKTVPLMCIVHCIRMLFFQGV

SEQ ID NO: 786382 - protein, 72 aa, Homo sapiens
TAGGCAEFPLPGPAFLLSTCANRPLPPSVPRALQAPQGPNFHGSTTKLLLPQPCPLRACPNHPSRISARSPL

SEQ ID NO: 786383 - protein, 130 aa, Homo sapiens
AYLHNDVPGRLILMPPLILMLHGVHFTQSSLLYTPWYTLTSQLSCRRFVLCFYTAGTCLALVINFTHFSFLSSDLLILNSVKLLSSHWISPPLTAGWKLPPGRHPSSGWLTSFVFVLSCIIVLCCLLSKV

SEQ ID NO: 786384 - protein, 105 aa, Homo sapiens
SVPEHDDEILSGDFTPPGSSVELVQIFSMDVVPGIHEGAVIVVSPSAHVALAAPPAAGEAVAAPLAPLAPKRLHRGVVAVSRSAHVALAAPPVHPGRKKCRKGSM

SEQ ID NO: 786385 - protein, 156 aa, Homo sapiens
MNNETTTLISLKEAMKRVDHKLQALETQFKELDFTKDNLMQKFEHHSKALASQAAQDEMWTAVRALQLTSMELNILYSYVIEVLICLHTRVLEKLPDLVRGLPTLASVLRRKVKNKRVRVVWESILEECGPARRRHHSTLYPSLLHVVTRAETLYC

SEQ ID NO: 786386 - protein, 148 aa, Homo sapiens
MGLLFWEDGVDHKLQALETQFKELDFTKDNLMQKFEHHSKALASQAAQDEMWTAVRALQLTSMELNILYSYVIEVLICLHTRVLEKLPDLVRGLPTLASVLRRKVKNKRVRVVWESILEECGPARRRHHSTLYPSLLHVVTRAETLYC

SEQ ID NO: 786387 - protein, 117 aa, Homo sapiens
SRSLLLSESRCCGRYLGKSEDPPVAAMSRLMLRRTPTVTSNTHRTQPPTWGKIKKLSQMVEENLRKAGQPVTMSNLMIAMRAVITIAVSIPSASTDTENNYTYRAYLSILAGNNAWM

SEQ ID NO: 786388 - protein, 87 aa, Homo sapiens
GKYHWRQNQDVKIPLSVSAVVTSLAKEEALAATGSLSFHIWKTEAVTMALANPLSLSSEIRNEQRMPPRKWNELSQPPCSGAGVPSW

SEQ ID NO: 786389 - protein, 51 aa, Homo sapiens
MGIWTFIPTFSRGRICVLRNGTRAIQHRRKEEKMKEKRRKRKRKKEEEEEE

SEQ ID NO: 786390 - protein, 128 aa, Homo sapiens
MEHRTNTSGVGMASAQGEHDAAATCRLAAMGSLARRSQRRTPRSDPEAQKTLSGDRDLAAGSKVASVDPSGRQGPGLGTPQLQLGRATPCCAVPWNTSQETRSRERSDRNIQLSGLTWPILPEEGDLL

SEQ ID NO: 786391 - protein, 88 aa, Homo sapiens
ERPEVRDQGGMRRCSFWPTLRGTRTGGALWDQRGKGIWLRPQSQSRGADRGQRGSCRAMGAAAELSWGTFRSDTDDFTSPGEAQATSS

SEQ ID NO: 786392 - protein, 282 aa, Homo sapiens
RTEAGLTPDRGPPIIQRCLCCRAWTTLQGKTSQAQSPPPHPATPRRFNRRELWRSEGDRLTSRTRGTGGALKEKICLWVFIAQLLPALLPAALTRVIMPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLS

SEQ ID NO: 786393 - protein, 185 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLS

SEQ ID NO: 786394 - protein, 69 aa, Homo sapiens
GEGVLKRLAAVRAQAGCLLQGGSAAPVGSQRADQATQGRCLIETGHYGPAEDMALGDSIRVALAWVPPG

SEQ ID NO: 786395 - protein, 145 aa, Homo sapiens
MPLHSSLGDGARLRLKNNNNNNKPPGYNYSFEKTNCYFPPNSCIKQLIRLGTVAHACNPKRLEVHPLSPSLPPPSNGVLGSPGWGQDEGTEEDKTYQDTTRPLTIPQTYIGSVLISVNPFKQMPYFTDREIDLYQGAVRLGLGGR

SEQ ID NO: 786396 - protein, 106 aa, Homo sapiens
GGRAPDDNSSSNNAAAATMALQADFDRAAEDVRKLKARPDDGELKELYGLYKQAIVGDINIACPGMLDLKGKAKWEAWNLKKGLSTEDATSAYISKAKELIEKYGI

SEQ ID NO: 786397 - protein, 106 aa, Homo sapiens; identical to SEQ ID NO: 786396

SEQ ID NO: 786398 - protein, 106 aa, Homo sapiens; identical to SEQ ID NO: 786396

SEQ ID NO: 786399 - protein, 299 aa, Homo sapiens
MTREQYILATQQNNLPRTENAQLYPVGIYGWRKRCLYFFVLLLLVTMIVNLAMTIWILKVMNFTVDGMGNLRVTKKGIRLEGISEFLLPLYVKEIHSRKDSPLVLQSDRNVTVNARNHMGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 786400 - protein, 142 aa, Homo sapiens
MASGLVVNLADALREVLLVECDLDMAWERRAVPLWMGSFRSLSRRLWGACVTLGRLAEPEAPALGDAVGWRRRITPPSISPLPALSPGGGESPSWEGEAVCPAWLPPRSQAGRAPLAAPSPASRWRRSPLSAQRGPGRKTEG

SEQ ID NO: 786401 - protein, 105 aa, Homo sapiens
CCGMGSKGTRYQVVCVCGDLRSRGDTESCQPRQLRVCDIGTCVILDGKSCGRSAEAARATGVLCCASVSSNKGPWLATMKARASEMHILWCRGWLQTCLWQQIQM

SEQ ID NO: 786402 - protein, 64 aa, Homo sapiens
ISQGGGDSIQRGRERSGGFGPGHVLAWGCGSRMQGIVKGAGERGSEKRGPGWKEAEQGENGGEG

SEQ ID NO: 786403 - protein, 193 aa, Homo sapiens
MFELFNVPGFYIAVQEVLALEVSWTSQQVGEYMLMSIVIDKGDGVTLVLPVVEGYVIGSCINHILIVGDTVYFIQQLLREREVGIPLEQSLETTKVIKEKYCYICPDIVKEFAKYDVDPWKWMKQYTGINVINQEKFIINVGYKRFLQPEIFFYPEFANPDFMESILNVVDEYKTVPLMCIVHCIRMLFFQGV

SEQ ID NO: 786404 - protein, 107 aa, Homo sapiens
PSEIILHIYNHLIFDKPDKNKKRGKDSLFNKWCWENWLAICRKLKLDPFLTTYTKINSRWIKDLNVRPKTIKTLEENLGNTIQDIGMGKDFMTKTPKAMASKAKIDR

SEQ ID NO: 786405 - protein, 131 aa, Homo sapiens
MTQNPQEPYHRASELEGAGDRSGPNSLRQSMRGDSDTKGRKAQSLPRAHGGTKKLLLPLKKKRRSSLLEARQGHLQRASAEQLARGCFLHDHLPCTVDPWGGWFRGFPGKSQGQRQEMMTSLSEPFPQTYN

SEQ ID NO: 786406 - protein, 56 aa, Homo sapiens
MKCTALLPALLPPLPPPNLCLIPHSFLASDLWAPLCQALGHGDKQHAVVGSVRRGQ

SEQ ID NO: 786407 - protein, 144 aa, Homo sapiens
MCRVQTHGCHPLRSVTVRPDPSPAAPPPHPGPPRQLSQGAQACLAPQPSGNPARRPLQVGSGPQVAKQRQQQPRLTPCPSLWRPGTPAISTTWVRLSLSGSPARVPPGVLGHLRGSLMGQAGQSELRALSGWCPNLSTPHSFPP

SEQ ID NO: 786408 - protein, 51 aa, Homo sapiens
MQGQTVVPKDSYTISLIQRLRGREAARRTHENLLRLSALVRSPQTASIDCH

SEQ ID NO: 786409 - protein, 212 aa, Homo sapiens
QLKTQPAQSKEDNTVVDIGSSPERRADLEETDKVGILQHPDGTVLKQLQPPPRGPRELEFYNMVYAADCFDGVLLELRKYLPKYYGIWSPPTAPNDLYLKLEDVTHKFNKPCIMDVKIGQKSYDPFASSEKIQQQVSKYPLMEEIGFLVLGMRVYHVHSDSYETENQHYGRSLTKETIKDGVSRFFHNGYCLRKDAVAASIQKIEKILQWFE

SEQ ID NO: 786410 - protein, 241 aa, Homo sapiens
MATEPPSPLRVEAPGPPEMRTSPAIESTPEGTPQPAGGRLRFLNGCVPLSHQVAGHMYGKDKVGILQHPDGTVLKQLQPPPRGPRELEFYNMVYAADCFDGVLLELRKYLPKYYGIWSPPTAPNDLYLKLEDVTHKFNKPCIMDVKIGQKSYDPFASSEKIQQQVSKYPLMEEIGFLVLGMRVYHVHSDSYETENQHYGRSLTKETIKDGVSRFFHNGYCLRKDAVAASIQKIEKILQWFE

SEQ ID NO: 786411 - protein, 117 aa, Homo sapiens
VEVHSGSCRLSCPSSVTVSESQVVETGTQPALAQEKCSRQMTARQGTVHIPCHPSKELKRGFGFSFWLGLFQPQSAYIQSREIFSYLNCNPELKFSPLAFLEPRKIGNSYFHLWHGK

SEQ ID NO: 786412 - protein, 143 aa, Homo sapiens
KTLPRQQVFLGGPQAVCVGVEWEVAGSPRRLLWFILPTRLLDSVGGHIRTQPPACRMWSRCGQLLAPPACVAGSIRARTSLYLGALPPLAVRLSPCWPRARLSSQSLRVLFPRVVSSLGPCCDNSIGDVAESPLGPEKWPRLS

SEQ ID NO: 786413 - protein, 136 aa, Homo sapiens
MGDSRRDVLHEPAIALLSSPQTQSRLQIDAFIARRCWGSQWDITGYIHQQDFPTAVFIGFSNEFNICIPHPFTEWLQCVRKYSQSWGVRKGQRHIRYGMCSERTHHLSRTYSSLLEREEKLAFYGVLTMCQIWSET

SEQ ID NO: 786414 - protein, 136 aa, Homo sapiens; identical to SEQ ID NO: 786413

SEQ ID NO: 786415 - protein, 254 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGRGDGYTGLGCGPWRG

SEQ ID NO: 786416 - protein, 291 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGRGDGYNGSGNDGSNFGGGGSYNDFGHYNNQSSNFVPMKGGNCGGRSSGPMAV

SEQ ID NO: 786417 - protein, 60 aa, Homo sapiens
MVHRMDGGEEKNLEAPLMLQARVSQSSTRRIAIGKEKEDTKSKQGQRVMGERPPPRPFLH

SEQ ID NO: 786418 - protein, 151 aa, Homo sapiens
VHVEDRSPGVVDMVGIAVCTCRPVAWLCKAGGEWPQEEPNPDAENPGWLLPLLSHATVGEPLRALEPQSPPVSNGSDDSIWSPPHSGEKVRENEQGLLRDRMWDVREREESGATPRTLVCEERQEEGTAIPGPGRLERLGRPRAQFWTCFV

SEQ ID NO: 786419 - protein, 66 aa, Homo sapiens
MRLKYPSDTHIKSHIQQQNELKIFQALAKSTELNKLYKSHSWEQVDFLSYGNLVQANKNNNLLATE

SEQ ID NO: 786420 - protein, 103 aa, Homo sapiens
LSSPSHPIPPSSQLELTKGPVIYLQSPCPELYQPQRCGINWCGQVHCADASRDPGWYRWVWHILYLPAKQSIQLTSHSTPYITLVGYSPFLGLKFHSVILVNQ

SEQ ID NO: 786421 - protein, 102 aa, Homo sapiens
VMCVVYALCVLCVLCVCCVCAVCGVCGVCCAVCVLCVWCLCDVCVLYVYGACVVCFVWGMSVCVCLLVFFPLQESKAPRVKIMSDSPKSPKPGNSAWHRVDI

SEQ ID NO: 786422 - protein, 169 aa, Homo sapiens
MCEASRRGEEMPRFPYFRAVHAFVSRKLLQLKQQHQQTRIKIIVHFPGFHVGLLSALEIQEIIMLLQQYGFVSGFYSYRHVFTGMRILYGKESPCFFLTYLSVPSTVKTKLLRTLSFLGEITCSYLGPPQQNGVAWVDSSSSSPAPRCQAAGCCPPGSCGTSMFCLGVV

SEQ ID NO: 786423 - protein, 85 aa, Homo sapiens
LRARRVKGAHHMRQQGAASDVTSSTQASRNTDTFKGQWAREVSAIQAKSDNPQTQSRTGCFVSAEHMPACRRLPHWGAQELKPHL

SEQ ID NO: 786424 - protein, 165 aa, Homo sapiens
MEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSNMASELAKYGLQLPAFSKIGGILANELSVDEAAGK

SEQ ID NO: 786425 - protein, 191 aa, Homo sapiens
YRVSSKGRRNMERRAAGPGWAAYERLTAEEMDEQRRQNVAYQYLCRLEEAKRWMEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSKMASEAAG

SEQ ID NO: 786426 - protein, 33 aa, Homo sapiens
MISVSVQDEEGAKPDRCDDRRNPISSTGTPGKH

SEQ ID NO: 786427 - protein, 415 aa, Homo sapiens
MDFEDDYTHSACRNTYQGFNGMDRDYGPGSYGGMDRDYGHGSYGGQRSMDSYLNQSYGMDNHSGGGGGSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDED

SEQ ID NO: 786428 - protein, 110 aa, Homo sapiens
MTVGPFPGLVPASWLTLEAQNFLKSAFCPTSVYCRTLQASLCLTVDPPDPDGVSLWHPQAKLLPFRSLYRPSSCLAVASLGQAHAPWRLFQAQLLPFAACPGPECPSLGI

SEQ ID NO: 786429 - protein, 107 aa, Homo sapiens
MELLHSESQVLKVYLSLLTHIWLYVPQDTSADFSAGCLGKHLLFNKSLTAIIIRVMAKVKALILLRYRSKENDEDEGNSGGTEEMGGRGKEVKKIIAHKAWQEFSDH

SEQ ID NO: 786430 - protein, 75 aa, Homo sapiens
RACCVALPLQLLLLLFLLLLFLLPIREEDRSCTLANNFARSFTLMLRYNGPPPTYTHWGTQVTFSSNLHQSQGPS

SEQ ID NO: 786431 - protein, 150 aa, Homo sapiens
MRSDGFISVWHFPCLHFSLLPPCKEGIYDKPTANIILNGQKLEAFPLKTGTRQGCPLSPLLFNIVLEVLARAIRQEKEIKGIQLGKEEVKLSLFADDMIVYLENPIVSAQNLLKLISNFSKVSGYKINVQKSQAFLYTNNRQTESQIMSE

SEQ ID NO: 786432 - protein, 48 aa, Homo sapiens
MPASWLPPSTHQLHSNDLQTLWGPVHPRPVLTLPTASPSNDDGVSPAA

SEQ ID NO: 786433 - protein, 75 aa, Homo sapiens
VLSRGAAELVGGLDLWGSEDSGSFHWAVAMLGCGGRPRAPVGLSETGGRCPVFTLLAAVRNMFTKALPSSGLEVI

SEQ ID NO: 786434 - protein, 138 aa, Homo sapiens
NIYGSQSGSVLLLQGRSNLGTGVVPAALGGAGVMALLCICLCLIFFLIVKARREQAAGRPEKMDDEDPIMGTITSGSRKKPWPDSPGDQASPPGDAPPLEEQKELHYASLSFSEMKSREPKDQEAPSTTEYSEIKTSK

SEQ ID NO: 786435 - protein, 135 aa, Homo sapiens
MSCESHCGWPEGATHSHFRLTGAFVPTPAFICVLFYVFSQSPELQALVTPDSSLLSPLSSPQHLYVCPRLHFPLFCLDQTTLTFLGLRATACSGRCLTAPANPLAPTPRPGFLNRSLSRSLSLASSLLNQEAGPC

SEQ ID NO: 786436 - protein, 135 aa, Homo sapiens; identical to SEQ ID NO: 786435

SEQ ID NO: 786437 - protein, 119 aa, Homo sapiens
MIKGLNHCHSLNSLTVGIPLRIYLQAPSLLTLYTVSPGNFIMAKITIYSKSMLKLIFLAEISLLRLKPLSPTSSLTPEFSGHLKTKFSISAHFCFLTFKPVPHSVLSVPRSGRNIIHLP

SEQ ID NO: 786438 - protein, 71 aa, Homo sapiens
TVSELLEVFAISTGYRRLIALDFDNIKTGLPQENPSVSFRVMQVKNHGVKLELNSDLKVYCNFSYGTAGFC

SEQ ID NO: 786439 - protein, 317 aa, Homo sapiens
CSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLDTLFKILGVLLHQPSHLLRPHLHVHTVVDATALPQEYSLSRAGGEQYSDLPKSRTSSLHAGLIDNRTGYSRRRRSCRRGGKLGRELTEVVAAAAPGQSRCRVRSKVRWVSVTTIPMRVGGAAIRLEVQRSSRPPPFSALLL

SEQ ID NO: 786440 - protein, 48 aa, Homo sapiens
MACTRDASICGEPRSRQCNSSLGDRVRLRIKQTKKQKDRQMALNIKYI

SEQ ID NO: 786441 - protein, 81 aa, Homo sapiens
RPSSPVPQSQSYIDTMPESEGTPGIIDSKRLVVPTTSPDPKKEKCLIQGCMTCLDTLWPPSPESLPSATSQSPHSHLLRCR

SEQ ID NO: 786442 - protein, 81 aa, Homo sapiens
RLGLPKCWDYRRVPPRPAHPLFPDHHTSLLMASWPPFRLPLLARLRPGDSFSNANDLYIPLFQTSMTPGHCKDRAQGVLTS

SEQ ID NO: 786443 - protein, 270 aa, Homo sapiens
MTCKPSAWTENRTENDLNRWSLSLSPRLQCNGTISAHYNLRLPGSSNSPASASQHCLSACDIDKAALPDHCLNCVIRNYLLGSDDEEITQTMLAMSTGATDTHKTSINQREMITDITTRLHRRIATRYGRNGTYHTVTNFHECFNICGCIPSALRKVGTMGRIEYSCWLRPYQSYDKRYSAKTSDPMTTMEHHSPKHRNDPGKGNFRTAHIHEPPADPVHIRREFNGGNNGWIGTHMINHWPHVIQRVTHNQDIIGEPTCDSNSGKHTAI

SEQ ID NO: 786444 - protein, 110 aa, Homo sapiens
HLATQQSCFLYWQLLEWCWAHPRHLGCLLNACQVSIGMVWSNYHAGLPVRNSGSGTREKRVQTLAPPLNQLCGTMGKTFSLSEPQFPHLQNRNCNINIEGCCVDRRWCRG

SEQ ID NO: 786445 - protein, 113 aa, Homo sapiens
YYPTTSYPHLLPSIKQFSCLSLLSSRDYRHEPPHLANFVFLVETGFLHVGQVGLQLLTSGDPPALASQTAGITGVSHRARPLWLTFNLSYYTLQLHNFDFVLLYNFYLFIDTL

SEQ ID NO: 786446 - protein, 104 aa, Homo sapiens
SPRLQTPMVHRTIACGGSRKEITEHWEWLEQNLLQTLSIFENENDITTFVRGKIQGIIAEYNKINDVKEDDDTEKFKEAIVKFHRLFGMPEEEKLVNYYSCSYW

SEQ ID NO: 786447 - protein, 88 aa, Homo sapiens
SPTPAPAICAVLIGADLAMQQGYTDPCGPRLPTDILFPKALAHSAEHLGTHNCSSRQMCEQVAHQNSSSGPLGAWVGRGRCGMEDRQR

SEQ ID NO: 786448 - protein, 66 aa, Homo sapiens
GRARRGLTAAGMQQGRCAGTRPGVGSGGPAVYGAECRPEMPSCPQKWLRPAGDRAGGWKLLHALCH

SEQ ID NO: 786449 - protein, 66 aa, Homo sapiens
VSHRAQLAQRNLNKGKGSLPCGSLGTVNPGRGNSNIKAFSPGLGGGLLHVELGRSGGNELEGGGVE

SEQ ID NO: 786450 - protein, 53 aa, Homo sapiens [sequence omitted]

SEQ ID NO: 786451 - protein, 285 aa, Homo sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQQVDNEISHSSSLLSCGSSRNGH

SEQ ID NO: 786452 - protein, 296 aa, Homo sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTCESPSNTKVPHDPSRLTHDMQSHDIPVAVPLQIFPMK

SEQ ID NO: 786453 - protein, 318 aa, Homo sapiens
MDCLCIVTTKKYRYQDEDTPPLEHSPAHLPNQVNAPELVHVAERNLSHLEAGHGVVGHAHLSPFKANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQQVDNEISHSSSLLSCGSSRNGH

SEQ ID NO: 786454 - protein, 164 aa, Homo sapiens
HGCAERCSEKTTIVRLENSKHWCDLQKSHTENTRRWKGGNEESAPGFHQIQRRGLPADRLLQKALWALRTHRDRGCGRALPLVSLTAPAPFTAVKSAGTSGNIGFWIRDTGEKGTPWLSPSLSLVCKRRVCSCGSSCDHKATNRRIKTNSQGWRVRTARPCPVT

SEQ ID NO: 786455 - protein, 158 aa, Homo sapiens
AHRKFSEPPSTSGRAREVCRKRTERSPCDRVASCSAPCWQSRSEAEMRSVTWLREHPGCLWMSGRGAERRQQWGASSAILGFSGQANFSPGWRPCTTPSAWWGPQLPRDWLRLCPWPWDGGQRFWAVAAAGGSSTWKTCLLSRPFLSGGAEPWLSLFP

SEQ ID NO: 786456 - protein, 70 aa, Homo sapiens
MKSRILTVPYIGFQTSKQVDSSSPVSNTSNSGDFLRIPGESPTINTESDLFLVTKSFIDSTGSYILWLGL

SEQ ID NO: 786457 - protein, 38 aa, Homo sapiens
MQFAWYWSESPRGWVILSKDHMVLAWYPQGSVPSSQYV

SEQ ID NO: 786458 - protein, 347 aa, Homo sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 786459 - protein, 189 aa, Homo sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFIACRPALSRLPVSQANSTGKGTWKGHCELQRAVHTVAHRISQ

SEQ ID NO: 786460 - protein, 150 aa, Homo sapiens [sequence omitted]

SEQ ID NO: 786461 - protein, 119 aa, Homo sapiens
MPHAQRLRTHTACSRVWVRARLLDPAHVLAGQGQPQGVRTDVVEILSLRGGLSLSFTCCRHHATPAWSPILTQPRWSHTVGVHTGTCPGSSTATVSVFRISGSSPSVNTNAPPLPSSST

SEQ ID NO: 786462 - protein, 65 aa, Homo sapiens
RRQKGREGYLLHMNLDPESSLELSARHVERFSGIAACSSVSLFGVIGSTGLPPPGSLDCLVITQH

SEQ ID NO: 786463 - protein, 125 aa, Homo sapiens
RVVSEPRPACGKLRRKAPRGACCTFMPGSHNCRPSPCVQRGSWTVEAGRETQSTPCPFYPPLFPLVQQISICGRVVGSQVMKSCKVWGRYKVSQGSWATTWGVTTWGGHLSTSSCFSLESKSSVP

SEQ ID NO: 786464 - protein, 443 aa, Homo sapiens
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIVFSVSDPGQARMDVGFLLFHSHDKLYNCVYLAINSEGNILSRAKETGSHIEGVTGARETERTMSATSGPLGLRVCPNLGLSRSSSLILDCQASLNTASHLRC

SEQ ID NO: 786465 - protein, 132 aa, Homo sapiens
MAGGSPAAKRVVVYRNGDPFFPGSQLVVTQRRFPTMEAFLCEVTSAVQAPLAVRALYTPCHGHPVTNLADLKNRGQYVAAGFERFHKLHYLPHRGKDPGGKSCRLQGPPVTRHLCDGAIGRQLPAGAPSYIQ

SEQ ID NO: 786466 - protein, 102 aa, Homo sapiens
MAGGSPAAKRVVVYRNGDPFFPGSQLVVTQRRFPTMEAFLCEVTSAVQAPLAVRALYTPCHGHPVTNLAEETVAGALICIQGFIHICPGEITLKHRCYPIPD

SEQ ID NO: 786467 - protein, 152 aa, Homo sapiens
MDLPDESQWDETTCGLAVCQHPQCWATIRRIERGHPRILGSSCKTPLDAEDKLPVLTVVDILDSGFAAHHLPECTFTKAHSLLSQSSKFYSKFHGRPPKGLPDKSLINCTNRLPKFPVLNLNETQLPCPEDVRNMVVCGSQKNRDTCEVSII

SEQ ID NO: 786468 - protein, 147 aa, Homo sapiens
MDLPDESQWDETTCGLAVCQHPQCWATIRRIERGHPRILGSSCKTPLDAEDKLPVLTVVDILDSGFAAHHLPECTFTKAHSLLSQSSKFYSKFHGRPPKGLPDKSLINCTNRLPKFPVLNLNETQLPCPEDVRNMVVCGSQKKQRYM

SEQ ID NO: 786469 - protein, 41 aa, Homo sapiens
MAILGLLGKDMLPASPAPIYKVKWISGSLSIRLSYELSDLW

SEQ ID NO: 786470 - protein, 131 aa, Homo sapiens
MPTTSATTCTLINPYFQPSPLSLLLHICMQIFTGHFHLIVSTSISNSTSLEPNYFAPLPWPQIALLLYSQNQSLPELGTQIPNPEIWEKTQTLPPPSLLKCRYSREQWLTPVILPLWEANGGGSPEFRTLR

SEQ ID NO: 786471 - protein, 42 aa, Homo sapiens
GKECETKRKFECNLILEGTVVKKLFKEYNYWLGAVAYTCNPS

SEQ ID NO: 786472 - protein, 184 aa, Homo sapiens
MILTGPACRPPLCPDNKMASQVKWYCGTVNKKRKNQVDTSSVTHTEHLQDTDERQASHRRWQKDFDEIFQTGLVAYVDLDERAIDALREFNEEGALSVLQQFTESDLSHVQNKSAFYVEFEDLQAERETGEQVQESTKGPDEAEDQALLERTGYTLDVTTGQRKYGGPPPDSVYSGVQPGIGTE

SEQ ID NO: 786473 - protein, 52 aa, Homo sapiens
MVIFCTIGDLLHDEVIFCSDTVIFCTIGDLLHDEVIFCTDKVIFCTIGDLLH

SEQ ID NO: 786474 - protein, 126 aa, Homo sapiens
PADGYQRGSVLAAAPSSLTLVFAHTEAGTICRKKSQSRATLCCRAVMRLIRGSASAASSAATVSTCLHPAAVGHDVRLNGFVLPYGCQPNGKAAVIPAPIAYIKVAAVKKLVVGSWERAGGPPRGE

SEQ ID NO: 786475 - protein, 53 aa, Homo sapiens
MRSHGHGSHRPTPGSVCLRGTPSNISFGAVASGLRTLVLMLYSSYQGTVMNFQ

SEQ ID NO: 786476 - protein, 51 aa, Homo sapiens
MTRYSRDRRDTLTSEDVAGVKTTCPVTCHTQQPRPRQGDPLQSCPTKTPGY

SEQ ID NO: 786477 - protein, 78 aa, Homo sapiens
MVKYFLGQSMLRSSWDQVFAAFWQRYPNPYSKHVLTEDIVHREVTPDQKLLSRRLLTKTNRMPRWAERLFPANVAHSV

SEQ ID NO: 786478 - protein, 314 aa, Homo sapiens
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 786479 - protein, 314 aa, Homo sapiens; identical to SEQ ID NO: 786478

SEQ ID NO: 786480 - protein, 138 aa, Homo sapiens
HSSTHPLIHLPTHSPSIYPPNNPPILLLTHHSILPFICRIIHLFIYPSTQSPIRPFYPSIHLSTHLSIYLLPIYLSVCPPNHPSSHPSTHPLIYPFSLPPIYLTIHPSIHPSIHPSIHPSIHVSTNPPGWRQGGDPNR

SEQ ID NO: 786481 - protein, 46 aa, Homo sapiens
MWPSGPGEVVLFVLHIDWEQVVRAEEWPRNLAEKVDAGSSATANLK

SEQ ID NO: 786482 - protein, 111 aa, Homo sapiens
RGLRMPLSSEVALITGMCHHTQLIFVFLVEMGFCHVSQAGLKLLTVGDLPTSASQSARITDVSHCAWPLFTLFLETGSGSVGQDGVQWHDIGLLQPLPPGLKANLPPQPPK

SEQ ID NO: 786483 - protein, 37 aa, Homo sapiens
MSQRPKTIKLLEENMGQNLHNIGFGDDFSDAAPKAQA

SEQ ID NO: 786484 - protein, 66 aa, Homo sapiens
PCHANVLLDNRKTDALGAESSQGEGQCLRSNSMDSSNTTQPEMVSLIQKLLAYCHDNSILPNLLGR

SEQ ID NO: 786485 - protein, 31 aa, Homo sapiens
MTPPPLPHFISYTITTRSTTLTTNTPPNHHL

SEQ ID NO: 786486 - protein, 69 aa, Homo sapiens
SLSVLKNLVYCVNTRAGFSTTNGKNISRDLGEITGTAVKRQSFSLDSSSDYELCEKVTSVPVTLDMGLP

SEQ ID NO: 786487 - protein, 102 aa, Homo sapiens
RDKGKFITALAVAKVSAFFSQFYEPQFSHGPRYKHALGCLGRKSEVRDPNIFIMGSEHACFLLQMKTVSPSYKAVSKLASCSKGRHYPCLPRIFSTQTYLKR

SEQ ID NO: 786488 - protein, 148 aa, Homo sapiens
SKESPPTGDSGKVDPVYETLRYGTSLALMNRSSFSSTSESPTRSLSERDELTEDGEGSIRSSEEGPGDSASPVFTAPAESEGPGPEEKSPGQQLPKATLRKDVGPMYSYVALYKFLPQENKDLALQPGDRIMLVDDSNEDWWKVTWQG

SEQ ID NO: 786489 - protein, 110 aa, Homo sapiens
MGRETVKVEDDIKFGKSFPFLRKAFWFSGQPDCYPLSSVHQILIQHLLWARYLFDGQEWKRKLKTPCTIILILLDSHEDNSAHLSIRQHAYGLKEWQVGNLLTLAIESQS

SEQ ID NO: 786490 - protein, 66 aa, Homo sapiens
ATSRERERGSLKPVGCGCGEPQAFLQSAPQSVPGFSLPSSASVPFSDKMAAALTGGLRASCLFPAQ

SEQ ID NO: 786491 - protein, 101 aa, Homo sapiens
TRFCDSQLKHGAPRPGMKSSPHDSHTCVTYPERNHILLHPHWNQDTEQETSELESLYQASLQASQAGCSGWGQQDTAWHPLSQTGKNATRGWGEGGGSYKS

SEQ ID NO: 786492 - protein, 121 aa, Homo sapiens
QAWPGSYSPSVPAVPLSFAGRQLRRGGSNHKPRCQGSHREWVPQAWFCSTRGHIQHNHRASDPRGPTGRSSVPKPRGKLSHPCTHSSRRAHQTSFQGQAKFPVQHRALKSTCHPLKVKANT

SEQ ID NO: 786493 - protein, 99 aa, Homo sapiens
VLSHPPPCAIFWSKRECFHCVQVWLKSIHCVQVWVKSIHRVQVWLKSIHRVQVWLKSIHRVQVWLKSIHRVQVWVKSIHRVQVWLKSIHCVQVWLKSIH

SEQ ID NO: 786494 - protein, 108 aa, Homo sapiens
PNDSLLQPPLLGSSNPLILASRVAGTTGVCQHTQLVFKFLVERSSCYVAQAGLKFLSLSDTPASASRSVRITGVNHHTWPYILFFDNCHSNEYEMVSHCIIDLHFSSD

SEQ ID NO: 786495 - protein, 54 aa, Homo sapiens
MPQKFETFQEPRTTMALKLQQKYSCWTQHWMSTSSFMSEFCFSGLSLSPKDRAQ

SEQ ID NO: 786496 - protein, 78 aa, Homo sapiens
LPASFIFTTVQKGAPLQASPLNFSCTWKDKPLLEAWQGFPFRASQCSAAVISRDPAGHGPHAAPSLNPTLFGLITLKV

SEQ ID NO: 786497 - protein, 55 aa, Homo sapiens
MSQITPLSTTKSHNSEHTTSNNQIRNLTDHTTSNNQIRNLTDHTTSNNKSQMSQI

SEQ ID NO: 786498 - protein, 100 aa, Homo sapiens
PFRSNISMISSVSTLGSKSKRSESIRALWVRVCPRNQHKLHHVLSAQFGCFVESCPLVGTTQIDICSIVDQQGSHVIAVTQHSWEMRSVVGMFNGKLSPK

SEQ ID NO: 786499 - protein, 100 aa, Homo sapiens
INEPKQITFSETDARQKFLCAPEELTGLSLQRWTTGQTLEPARNSSKCTGSGMGIWLYGTSRLKGTPGRDSFVTKPGVTHQKSATTKTRKCQQCRAGEVA

SEQ ID NO: 786500 - protein, 145 aa, Homo sapiens
MVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTV

SEQ ID NO: 786501 - protein, 797 aa, Homo sapiens
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVEDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 786502 - protein, 103 aa, Homo sapiens
HLHRLQLPPPRLPLSLLKSLPCKMKLTYKMGSDADVQVLGTSLTSEPALLTGRDVSTEVGRSLTWSQGAPPLECGLGPVTLTGQDVTPALRLCGKDKELCSCN

SEQ ID NO: 786503 - protein, 939 aa, Homo sapiens
KLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARPVLAGIVATICFLAAAILFSTLAACFVNKQRKRKLKRKKDPPLSITHCRKSLESPLSSGKVSPESIRTLRAPSESSDDQGQPAAKRMLSPTREKELSLYKKTKRAISSKKYSVAKAEAEAEATTPIELISRGPDGRFVMDPAEMEPSLKSRRIEGFPFAEETDMYPEFRQSDEENEDPLVPTSVAALKSQLTPLSSSQESYLPPPAYSPRFQPRGLEGPGGLEGRLQATGQARPPAPRPFHHGQYYGYLSSSSPGEVEPPPFYVPEVGSPLSSVMSSPPLPTEGPFGHPTIPEENGENASNSTLPLTQTPTGGRSPEPWGRPEFPFGGLETPAMMFPHQLPPCDVPESLQPKAGLPRGLPPTSLQVPAAYPGILSLEAPKGWAGKSPGRGPVPAPPAAKWQDRPMQPLVSQGQLRHTSQGMGIPVLPYPEPAEPGAHGGPSTFGLDTRWYEPQPRPRPSPRQARRAEPSLHQVVLQPSRLSPLTQSPLSSRTGSPELAARARPRPGLLQQAEMSEITLQPPAAVSFSRKSTPSTGSPSQSSRSGSPSYRPAMGFTTLATGYPSPPPGPAPAGPGDSLDVFGQTPSPRRTGEELLRPETPPPTLPTSGKLRRDRPAPATSPPERALSKLQQLVFQLSGQCCRDKPLLSSIGKGAPRLGGRGRAGGRGFGRAIASWTGPDQGSKPCPSPPRVGGLLPLLDPHGFWVPHIEPRSAPPSCSFCPPPPVPMSGPSRAPCGSPHSSPASPACCQYTQGLPQKPWGPACTPKGPRTPEICFASLHPWGPLWGPSGIQEEPPRTLFSQQPQA

SEQ ID NO: 786504 - protein, 393 aa, Homo sapiens
MWWRVLSLLAWFPLQEASLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKRENEVSEHTLESYRSRSNNEETSSEEKNGQSSHPMRCMNYITKLYSEAKTKRKENVQHSKLEEKHIQVPESIV

SEQ ID NO: 786505 - protein, 221 aa, Homo sapiens
HTVLGFLHNLYKQVAAKYILQSLLLSTMWVKLLSIVAEFCFSPFLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKRENEVSEHTLESYRSRSNNEETSSEEKNGQSSHPMRCMNYITKLYSEAKTKRKENVQHSKLEEKHIQVPESIV

SEQ ID NO: 786506 - protein, 68 aa, Homo sapiens
RIQASNDVRGHGRGVEGLKHNLSHLLSVGLGVQGGLGQQHWVLLRGHAQLVVEGVVPDLLPFFSDQFI

SEQ ID NO: 786507 - protein, 116 aa, Homo sapiens
GPPTTIHTKCSLQDAVSKSRQGPNSGQPLLPADLNKGCAIVFYYYYYYYYYYYYYYYYFNHEGQVVAPRSSSYLSYFCFFPTFCFLPFLLSYKLGKRGGGGEAGKDNRRSGGLIPQ

SEQ ID NO: 786508 - protein, 130 aa, Homo sapiens
FLNGNPSMTTYLTLQHDLLTLPRIFLASVLPSCLECSKPTYYEFHCSTFMLSAYQIHLLFLYWKKFHASFKILFHCLPVKFSLTSILSLAPFYLVNYTILYQHKLYYNYILISFSLLSYEFLNSRFVRSS

SEQ ID NO: 786509 - protein, 327 aa, Homo sapiens
GHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFS

SEQ ID NO: 786510 - protein, 85 aa, Homo sapiens
QSCSGVTRLAKSKVPEATSLDCPAGPTFKAAPQDPLAAVDWGPSAPGPFVAASTGAPVASQSQLGGQMVAGAMVTVGKEVLGICG

SEQ ID NO: 786511 - protein, 134 aa, Homo sapiens
MPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKH

SEQ ID NO: 786512 - protein, 40 aa, Homo sapiens
SHSVCTSSHTLSFFLLPSGAALSNMVAPSHMWLLKLIKFG

SEQ ID NO: 786513 - protein, 52 aa, Homo sapiens
PTPLWGRTSNPWLLTLAAKSREAAHNPSGSVSVGPAMEARGWESQGCPRHSR

SEQ ID NO: 786514 - protein, 84 aa, Homo sapiens
HSGKFSAMISSLLPLPSSLSGLHVCVPLPEVEAALGCLFYPTLSLCDSVSVSLDLAMGLEQQPLVLALKQQQQVVQQQHMHLQE

SEQ ID NO: 786515 - protein, 72 aa, Homo sapiens
SLFGNWRRQSRQAIFFQSASFSSSLSSLSTSSSSLSLSPLQARLAVLPRLVSNSWAEVILLSQPPKVLELQA

SEQ ID NO: 786516 - protein, 111 aa, Homo sapiens
MPLNLHNPPLAHTGRNLRPPDNQCLPKMELKLNPSQEDAGLHKAEFGNILMRKLSHERNFLLLPKLSRAQIRAVNPFSRNPNLWLTGAGTAPGSTHTYFILSRLHSGIRAR

SEQ ID NO: 786517 - protein, 104 aa, Homo sapiens
MPLNLHNPPLAHTGRNLRPPDNQCLPKMELKLNPSQEDAGLHKAEFGNILMRKLSHERNFLLLPKLSRAQIRAVNPFSRNPNLWLTGAGTAPGSTHTYFILSRP

SEQ ID NO: 786518 - protein, 57 aa, Homo sapiens
MHMLMCVVHSHEHAPMCVPVCVHLRASVNECVAVCKFQCVVVSVGVWNVHLCECGSV

SEQ ID NO: 786519 - protein, 110 aa, Homo sapiens
QVPPAHSESQVRCHFRDWLGPVDGPALAAPVWDLSWGPAPGVATTHECWCFCLWILSGMRRVDILTWELLIFNFSLIDTVVFSFISRSFPSIVRLTNGVGFLTFICSCSS

SEQ ID NO: 786520 - protein, 84 aa, Homo sapiens
GLTVMLEGKEEQVTSYVEGAGKERVCAGKLPFLKPSDLVRLIHHHENSMGKTCPHDSVISCWAPPTTSRNYGSYKVRFGWGPRA

SEQ ID NO: 786521 - protein, 119 aa, Homo sapiens
VLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRDLDSFATEPEFNH

SEQ ID NO: 786522 - protein, 90 aa, Homo sapiens
TMCQTLFWVLEDKALPLGSLHSSGKTVNKVQTNEKRRPCQIPASAINTTERLSKRAIGGGSFSSGAGEGLSEVSGAETQNTRSKLFEELR

SEQ ID NO: 786523 - protein, 61 aa, Homo sapiens
MRGSCSLWRLCSCLDAQEACGSLGFFATQEVKTSLSWEAWVCLADRASQMQGWHCHGKGTL

SEQ ID NO: 786524 - protein, 119 aa, Homo sapiens
SHQSTCVSRWVLWLLFRLLLGFISHQSTCVINTLADHRHRGTDFGGSPWLLIITVFLRSYKFAISLCTTYLWVINTLADHRHRGTDFGGSPWLLIITVFLRSYICHLPHNLPLCVFPEE

SEQ ID NO: 786525 - protein, 72 aa, Homo sapiens
TMKITRNELVLRDIQANRLTGDATKLMGANQLNLTPCLVWAHHLSLSQTNFTVKSYHIPCLNFWIRGGFTSS

SEQ ID NO: 786526 - protein, 55 aa, Homo sapiens
FYVLYSLCMPLLAAIGGRPLPLPILGLHCFGFPGQLPSVWASEDSQPEPNINNVP

SEQ ID NO: 786527 - protein, 68 aa, Homo sapiens
MSSSDYLLTGPDKVTHTPRLETAIRSRMGTHPAMTIATHKGDTRWMANHTSKGQRSQTQLITQYDRAT

SEQ ID NO: 786528 - protein, 154 aa, Homo sapiens
TEQHTHPRNGTHSHGTADSTTEQHTHSHRQHTHTHGTAHSPTRGRWVSCSFSSSRPFPGPWSSPSFEHRCLLERDLLVRTMSVPATTSFGLREAWNVLNAPWGSSLLRSQGSRVCCLSCRQMRSQGWGLCGGSPERTAAEVERVLPERRPGRGN

SEQ ID NO: 786529 - protein, 69 aa, Homo sapiens
KDSVLPKNTDLGRADHKAKGSHGDRCEVWELLQVTSKRRFIEDQGRGPQRTNCASDSFLLLFFLAEIDD

SEQ ID NO: 786530 - protein, 196 aa, Homo sapiens
GDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCA

SEQ ID NO: 786531 - protein, 83 aa, Homo sapiens
PHETPRRCIGNINPLSGSSSTLLLSELGCSFVLATTKVYANLHGFLPPSRHLSKKFPEGSADGAGSETPGSASFREPPTTQDS

SEQ ID NO: 786532 - protein, 102 aa, Homo sapiens
AEWQSVCDATSSFLPLFGFIFTRLLLGVFLVIQSLSVQSVVLGPAALASPERLLEIHNLRPHTALLNQNLHFNNTPRCLRSHYSLRSTDGIPKNFLNQSCMN

SEQ ID NO: 786533 - protein, 112 aa, Homo sapiens
MIYKSYITSHQQSPSLLPHNSFTFFFLLYIIPYHSPSAFFSSQSSLFCHSGRIYTSTVNTVSRLLPLMVLFLKCFYLKSQKFDSFSNSLLKRYPIRGFPQPPNLKQHICWAW

SEQ ID NO: 786534 - protein, 79 aa, Homo sapiens
AWAAACCGAAAAPRTLHRLLLKPDPQPSQHEGKHGVAAVLFPDGPQSSVQLSQSTFLLRIIGQTQWLMPVIPALWEAEA

SEQ ID NO: 786535 - protein, 76 aa, Homo sapiens
IYKIFGTIPLGSQALDACCPAMREHQRVTAYPKVPLTEQNIIPCNPKAGTQLGPRKTGIVLESLAVLRVLSSGCLA

SEQ ID NO: 786536 - protein, 245 aa, Homo sapiens
DKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEQPYKCEECDKVFRCKSHLERHRRIHTGEKPYKCKVCDKAFRSDSCLTEHQRVHTGEKPYMCNECGKVFSTKANLACHHKLHTAEK

SEQ ID NO: 786537 - protein, 66 aa, Homo sapiens
CQTDPTQPQAGRSQGQQKPPWPVHSAATLLPQANPLSGRELPDSLLPMHHCTQGTSSQNKDSVNWD

SEQ ID NO: 786538 - protein, 41 aa, Homo sapiens
GRGKEGRNDERKEGKKGEGQKEKKKREKEAKKASTKDSESP

SEQ ID NO: 786539 - protein, 115 aa, Homo sapiens
RLHSGPLWCFSCSALSSSPTGPQGPSKGLNAPPVDSSALQLSMILPTHSSTPRYLPFLHGHPYAASLHSPVKSLCTPGSKRNETGGTRRPQRLPCVRRGGCVDEEIIDGGGWILY

SEQ ID NO: 786540 - protein, 112 aa, Homo sapiens
TPLSHCVCRDGKIGPPKLDIRKEEKQIMIDIFHPSVFVNGDEQEVDYDPETTCYIRVYNAHERWLVVLRSRRSLWWEKRQQLPRNQPPKSHPKRAPWDTIQGCRWELYSLCQ

SEQ ID NO: 786541 - protein, 73 aa, Homo sapiens
ASGHLCKELDFLPLSASGNGRIISLFPQCTWPRGYCTKETFKDNPYTSAFRPQSRMQAVCSDRNDCPPKRGLR

SEQ ID NO: 786542 - protein, 344 aa, Homo sapiens
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 786543 - protein, 315 aa, Homo sapiens
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 786544 - protein, 315 aa, Homo sapiens
MATPYVPVPMPIGNSASSFTTNRNQRSSSFGSVSTSSNSSKGQLEDSNMGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 786545 - protein, 161 aa, Homo sapiens
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKIITMLTF

SEQ ID NO: 786546 - protein, 235 aa, Homo sapiens
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIANCLAVREFLCLDDPPGPFDSLEESRVSAVLYST

SEQ ID NO: 786547 - protein, 344 aa, Homo sapiens; identical to SEQ ID NO: 786542

SEQ ID NO: 786548 - protein, 344 aa, Homo sapiens; identical to SEQ ID NO: 786542

SEQ ID NO: 786549 - protein, 315 aa, Homo sapiens; identical to SEQ ID NO: 786544

SEQ ID NO: 786550 - protein, 114 aa, Homo sapiens
MLPGPEEPSSNLKHYLIPRMAQTNSRQSTSAGNPACLSSPDFGMWNLKHFLFPLSCSRSFALLLLGALTMSVWPWRHGLQARCEAYKNESKHLCLPCKIQEMISPHSDTLIELH

SEQ ID NO: 786551 - protein, 36 aa, Homo sapiens
MPPFWFLRCPPVSPRGTVTPSACLAANVTPATRERS

SEQ ID NO: 786552 - protein, 55 aa, Homo sapiens
MTAFTEVKDCNIASFVKSLQPEVSSVIFSLKNIITSTGRRVGENRDLAISRLDEV

SEQ ID NO: 786553 - protein, 76 aa, Homo sapiens
LVFELEELRPLKTGYYPAGAGVSEWNTMELVWQLLGKTTKWIQQLLQEGPATVWVKECCQSDPYRNRKQKEESQLG

SEQ ID NO: 786554 - protein, 82 aa, Homo sapiens
RKETGYNMTTESLHACFPSISGVCSSRITWAQEFKTSLDNMVKLRLYKNLKVSWVWWCAPVVPATWEAEAGRSLEPRRSRLQ

SEQ ID NO: 786555 - protein, 117 aa, Homo sapiens
GASCWWVSKSGVCRVVALCGGSKSVFSFCTALVEVSQELCVCSRLLPGNSGRWGWEADPSPMVKHHLLDADLVTVSSYEIWLYNKVWHLFPLSVLLLFQPYETSPCPLAFWYGCEAP

SEQ ID NO: 786556 - protein, 141 aa, Homo sapiens
MDAGMPTGRSQLSSEVAACRTKTQGCHEEEPLGPPASSRTPWSFIMAHAQHTADNRFSSPWSPRASPSFCLGSLMPTHQLFQAPKGKLKKNLVPGPAAKPQDHTALEPCCQVRLGGPRRGSPPAWEAASPALAKHHLANCS

SEQ ID NO: 786557 - protein, 102 aa, Homo sapiens
WEAQSTSPEQKEDLGGGCWLTQLLLSPIRPIQKSASCSLMSLGQGLPTLRDLGAGGPHITETHMIVSSVTQGTLNPHSSYMWGNKYRGTEREESHSRSHNVG

SEQ ID NO: 786558 - protein, 119 aa, Homo sapiens
MNRPLPQLSDLLWSLALCLESEWPGHVLQAEGPQQGSLSPERWDRWAFWGLAHQNPQAGGLLVSAAAAALGDSVLGFCPHFTATTQEWRGRQEPQPHRGGRTLSQPCLAAAAGSQVSPM

SEQ ID NO: 786559 - protein, 77 aa, Homo sapiens
TGLPLRHESSSPEIPLGARHFLLGTESRDLDPAGRRRALHNTGPLSIRAYWKVVRPAKSCHLDIWDKEGPWRSGRRE

SEQ ID NO: 786560 - protein, 85 aa, Homo sapiens
QKKEQKLWYSSSMGIRNPAPVFLSTLKVASWSEMTTRELAIMSTFQAKNRRGQSDICPLPFNYSFLEVPYNAGQKLIMYVDIPTH

SEQ ID NO: 786561 - protein, 34 aa, Homo sapiens
MEFRIRPLPWHRYRKVDYFSHHATLRHRKRLSSR

SEQ ID NO: 786562 - protein, 270 aa, Homo sapiens; identical to SEQ ID NO: 754352

SEQ ID NO: 786563 - protein, 218 aa, Homo sapiens
SALPCLRLDVVNLPTSLRHKVNEHEQDGNELQTTPEFRAHVAKKLGALLDSFITISEAAKEPAKAKVQKVALEDDGFRLFFTSVPGGREKEESPQPRRKRQPSSSSSEDSDEEWRRCREAAVSASDILQESAIHSPGTVEKEAKKKRKLKKKAKKVASVDSAVAATTPTSMATVQKQKSGELNGDQVSLGTKKKKKAKKASETSPFPPAKSATAIPAN

SEQ ID NO: 786564 - protein, 87 aa, Homo sapiens
MTPREKALDTGQDAQRCPICPRGWPSAGMTSGEHTDRSPSYSTKHPPPPARTGLMSLCPQLLTAALTSAEGRGQTAHHHYPTSRGSA

SEQ ID NO: 786565 - protein, 70 aa, Homo sapiens
ISLEGWRWLSGRRGHTGSLDNPELFQEESTKKINRPVASRWTDNLSLSKERQEGALWGQGPSRQEGAKVR

SEQ ID NO: 786566 - protein, 68 aa, Homo sapiens
HHHRCIIATTSIIITYITVTSTVTAITSIIVVTSVTTTTTAITTSLSQQGHMSTETGAAAEGDSGEAV

SEQ ID NO: 786567 - protein, 182 aa, Homo sapiens
VLIVIFEISQAYLADNRAQRAKMTNTKGKRRGTRYMFSRPFRKHGVVPLATYMRIYKKGDIVDIKGMGTVQKGMPHKCYHGKTGRVYNVTQHAVGIVVNKQVKGKILAKRINVRIEHIKHSKSRDSFLKRVKENDQKKKEAKEKGTWVQLKRQPAPPREAHFVRTNGKEPELLEPIPYEFMA

SEQ ID NO: 786568 - protein, 265 aa, Homo sapiens
TPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENQRKYLDGPHKLNPGSIAHLAHHKALNDLSASKTGETPSGRASTDGTEREPRQMGPMSSHRMQCQGRHAHITSHGRCVNWPRRQNLAGL

SEQ ID NO: 786569 - protein, 157 aa, Homo sapiens
TPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICESGGLAVAGGPWCQAQMEAF

SEQ ID NO: 786570 - protein, 103 aa, Homo sapiens
GGYSGEWDSAPALKKFPVCKNNPRSCGIPDERELNLLAAVRESWALGDGRSSAEILAGWMVYAEITGGRIIRVSPSEPNVVQPALVGGGQTPGTPEASFRRGK

SEQ ID NO: 786571 - protein, 71 aa, Homo sapiens
DVLQAAGEWEPAAQPPEEEADADLAEGPPPWTPALPSSEVTVTDITANSITVTFREAQAAEGFFRDRSGKF

SEQ ID NO: 786572 - protein, 120 aa, Homo sapiens
GEKERGMACLYPSHVAAHQVLGEWEPVQGGKSSENDKWTMSDPGAEAPTCSRAASGVDKEQQGRLRPGVLGSTVSSHSLGHQNLSKDKTQCLWQQRARGIMCFRGGRRGCTPWKQYIVLQ

SEQ ID NO: 786573 - protein, 122 aa, Homo sapiens
LCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEMLTGG

SEQ ID NO: 786574 - protein, 285 aa, Homo sapiens [sequence omitted]

SEQ ID NO: 786575 - protein, 138 aa, Homo sapiens
LSAMSISDKQPAVKADSTLTSVSATLPVALGWSLGPASLAATGLYGGQQHPKSLPALPLLLFHQLLLAHYCLFHLTPVLVLFLLPGRKGRNEHGNTLSGALTYSLKLDVSGLRSASDLKPFFRAEIACVLNPLDGQTL

SEQ ID NO: 786576 - protein, 93 aa, Homo sapiens
RSPPAGAQSALLKCGFAIQALHLPIVQMLLVAKLSVSSLSDFMCTQRICSVHSFMDTFASLYSKPKDYMVKVNSKSEPFSPFTSWQSEPFRWL

SEQ ID NO: 786577 - protein, 115 aa, Homo sapiens
SFSSSPSSFFLLSPSSSSLFRFLFSSYSSSSSSFLFFFSFSFSFSFSFSSFFFFFSFYILYLNFVFTHHFKVFCSMTAARDLNTLLHFMAIHSLFTRFPSNGTVMLLKPHLKDLI

SEQ ID NO: 786578 - protein, 38 aa, Homo sapiens
MVFCYGRLTRLMHRLYPPWDINSMKVWLDCQPGAVWPM

SEQ ID NO: 786579 - protein, 105 aa, Homo sapiens
LCLARLLCYAFVCITRMQFADSSCFMPRFIRLPFVQHPPSAWPLVDHSCHFTYSSDSSSDQAQYERWRHPLKPIRKHARLRLVDDKHRPRPGNPSGGRGIWTFLN

SEQ ID NO: 786580 - protein, 256 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 786581 - protein, 280 aa, Homo sapiens
MPLHKYPVWLWKRLQLREWAFVFHTVSVAARELNVNTFERTYPPWGTGERGTSVERSPKLSPPVVSSLNYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKYFEYPEESTFFSIGWTLSEFFFTPGFYPEDPERRAAIYDKYKEFAIPEEEAEWVGLTLEEAIEKQRLLEEKDPVPLFKIYVAELIQQLQQQALSEPAVVQKRASGQ

SEQ ID NO: 786582 - protein, 283 aa, Homo sapiens
MPLHKYPVWLWKRLQLREWAFVFHTVSVAARELNVNTFERTYPPWGTGERGTSVERSPKLSPPVVSSLNYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 786583 - protein, 252 aa, Homo sapiens
MCIFLIPLAGSEEANGGTPQSRISRETRLPPIHLHRMKSLIRSKAERPQGGRHTGISTLGKKAKAGSGLRKKQRRLPRSVRSTRDVQAAGKKEDAPQDLALAVCLSVFITFLVAFSLGAFTRPYVDRLWQKKCQSKSPGLDNAYSNEGFYDDMEAAGHTPHPETHLRQVFPHLSLYENQTPLWVTQPHPHATVILDSTLGRSRKDPGSSQSPGQCGDNTGAGSGNDGAVYSILQRHPHAGNRELMSAAQDHI

SEQ ID NO: 786584 - protein, 112 aa, Homo sapiens
MSLWLCFQCPLGVSKSNKKRINLCEEIPFDILEMAACKLLKHLNGDSLLLPRLECNGTISALHNLCLPDSSYSPASVSQGAGITGWCAMVRLLLTTLPPSGIQAILLPQPPE

SEQ ID NO: 786585 - protein, 144 aa, Homo sapiens
MEIHSCCPGWSAMAQFRLSTISASQIQAILLPLSPKELGLQMKAPLSSKKSTSQATAGVQWCDFCSLHFHLPGFKPFSCLSLRSSWDYRHVPPCPANFVFLVEAGIHHIGQAGLELLASSDLPASASQSAGNTGMKQPHPAWIN

SEQ ID NO: 786586 - protein, 118 aa, Homo sapiens
MHCATWGSHCPSLGLAFPIFDRTWLCLATPPPMGEFLGLPLSWLQLRCQSQPCPSQEQWARQGQSPPVPGGSTHGPGLFSALADGVRRGFSTPSTMTALDHCPAVTRGTCLPQNISCP

SEQ ID NO: 786587 - protein, 78 aa, Homo sapiens
VRNGYGFIHRNDAKEDVFVHQTAIKKKPRKFLRSVGDEETVEFDVVEGEKGAEAANVTGPGEVPVKGSCYAPNLRKFR

SEQ ID NO: 786588 - protein, 87 aa, Homo sapiens
VSMLPSLGNCFFHGSLQSTDQKIPLMRPHHQGLGCQLQSHADSQQPLSWSLPKKLGRVVIITVAACCLNPLSSLGEGEQSSLWLLAA

SEQ ID NO: 786589 - protein, 128 aa, Homo sapiens
GPDDGEARTAAALGDRYRVTRPEPAAVPGIVGDMQWLALPTKEKHRKAEFATGELCIAGRPASSPDASRAREQPGLCRAQLRGGPCGPGVFELRAELTPSMHIDWKKEDLGKWILCCQLLVSPSLLPS

SEQ ID NO: 786590 - protein, 45 aa, Homo sapiens
GPGEADWRKSRAWRGCKAANTRPGKAALRHGLGLQRPLAGAGPAE

SEQ ID NO: 786591 - protein, 60 aa, Homo sapiens
SLRAVGVILALPIFPESDRAAQSRQSHQAEERRCWQWSVPLVCPGVVEVSQCSLKKKEGV

SEQ ID NO: 786592 - protein, 43 aa, Homo sapiens
TLPANLSTRLGQTIPLPFAYWNQQQWRLGSLPSGDSTETGGCQ

SEQ ID NO: 786593 - protein, 106 aa, Homo sapiens
FPVCEKVNACIALSTVPVTNYALKKRESCPVVLKPATQEGFVFVVTFLSNFLSSYWISWCCFSGGGSALTGGHSSQLGSGAPQCGHRRGTVSCPWVQGLQSCFELK

SEQ ID NO: 786594 - protein, 204 aa, Homo sapiens
TCILDINKQVVGGRKVWISDQKSLDISAQSHDESGEGARASQAQMPRSPLEMAFRCRFLFHRSGWSPKFCSWRADSENMSWCFSSFCRRTPLRVLVMEGNPKTTGVRDRYSDAFSRNTLGTARKPLLAHSFAGISSHQACGCASWYRFASWSHGFCSPRREGKVWCSLREACSFAGRRGRRTGGPFGAEEAEESKLGAVPLLQP

SEQ ID NO: 786595 - protein, 76 aa, Homo sapiens
IAKCVTYHVVFSFRGQIQNAPLPSRELLEKFLFQVPKEHSVHSSVQLLQTDRAHGSRKQSQIFIFTYYGLLPCLRN

SEQ ID NO: 786596 - protein, 105 aa, Homo sapiens
HQPGLCPSLLLPLSTGLHHHYCPGPVHINHGETGHSWGQLLKRRTSAFGLHFLSLPLSSLSFSWNQRHTHVAPYFTFPDLHSPPIHKSRQTSAGCVVRKAAETEL

SEQ ID NO: 786597 - protein, 101 aa, Homo sapiens
MPVCLQETWLGVWGKTASALSARREGMRTSVHQQNQSTAISACLNRPHPKIKMQGEFTAHQLSDLEVQRIPGEASAWAQVGGPAQRGRYSASFFLTLYGGS

SEQ ID NO: 786598 - protein, 149 aa, Homo sapiens
FFFEIESHSVTQAGVQWYNLNSLQSPPPRLKQFSCLSLPSCWDYGRAPPCPTNFCIFDRVRVSPCWQAGLELLASSDPPALASQSAGITGVSHHTQPAPLLSLETIYCGLCQSGTAWISSSPIYLLRDPRYSFLCLFPQLHRNSTYRIG

SEQ ID NO: 786599 - protein, 91 aa, Homo sapiens
ANKDEKATLQRIYLRPPWVVGTQTIPSPVQLMSKKCLAFSFLVVLLPALRCFLLATCRPGCSQRLKGALLQISRALSLTCSLLSYVFLHKF

SEQ ID NO: 786600 - protein, 84 aa, Homo sapiens
DAVSKKLARQPKEKSSDNNKLALFLYPQFLIGYLGNVAGDSFLQHHFQGVYKLPLQIHCPHLPQVRETIWAECLLPLHSHAQVR

SEQ ID NO: 786601 - protein, 77 aa, Homo sapiens
WGKWAPPILQAGDGVASIFKQLLPSPCLFPKVISPERKKKAERSLTGERQLSVVAFSPLLSLTFPATAHIPNNMAQL

SEQ ID NO: 786602 - protein, 121 aa, Homo sapiens
REAPRPASSSRFQSHQRSILIQDHIVFFFFCSQISLCLSPLVTTMAGVLTCQGNSLGSREWDPQCSGGCWDLGARKESGSHDSLHSQCSVARTGHLGIALLNFADLETEKGLDLQTWTALD

SEQ ID NO: 786603 - protein, 121 aa, Homo sapiens
MGSVERPPLPRVPSTAPAPRPEVWMLVSQVNWRFFHGHRSKSAWYAWRPTAFLFLGTPGVSCCPFVLRKNSHTVFLLLPPQQLSTQKVGVKGLPHAPRRGRCCLLIQFQQYGPGVASDRTG

SEQ ID NO: 786604 - protein, 105 aa, Homo sapiens
MRVGRLESGRMWSVFQPVLAAEAGENNCVKRGLPQCRTGSHHVSTTSTCRSQASSCPEYHALAFYISGFYFYISSPEYSWNIAVPMTGCMIFPPLCTQFVYYCII

SEQ ID NO: 786605 - protein, 119 aa, Homo sapiens
HTIHMPTPMIPSPPFRHSPVLHSDIFRHTGTVSFTLLLVPTHVYMCVQMLMLCTRIHVCTHVCSRVHTLMHPQHTHVHMFHCTALYYILCASALMYTHVHVFYCTALYYILCTSSLMHS

SEQ ID NO: 786606 - protein, 91 aa, Homo sapiens
QAVPSSPPGCTLLSSRVYPPLLNHPSSTSRLPPEPQRGPPTQQEPHLRCCSLLAPCFLGGPTTPWNYTGYTGMRVMTCFLCTQHGTFVNVY

SEQ ID NO: 786607 - protein, 279 aa, Homo sapiens
LLCSKLETPPSGANPRGGHQCGSALSCDEGVPAAQGASSEKPHECTKCGKALCCRSDLRVHHGVHAGEKSSACSERGSGFREKLCPDKQGTHTKEKPARDSRSGKTIFRKTRLCVPGTVHAGAKPYKCWECEKTSHKSRLIEHLRSHTGEKPCGCRECGKAFFQKSHLILRQRTHTGEKPCDCAELRESCSQDSCLLTHRRTRGEETVRVLRLREDLPEGEPHPPPRDPHEGEAAWVKRPWDRHKVTSRGRRTSRRDIARETALNQNYDATLGRGPISG

SEQ ID NO: 786608 - protein, 123 aa, Homo sapiens
LLCSKLETPPSGANPRGGHQCGSALSCDEGVPAAQGASSEKPHECTKCGKALCCRSDLRVHHGVHAGEKSSACSERGSGFREKLCPDKQGTHTKEKPARDSRSGKTIFRKTRLCVPGTVHAGA

SEQ ID NO: 786609 - protein, 79 aa, Homo sapiens
LTAHSSHFSPESCSPSRDMAPSCWFAIVPHGHPGNSSGRPVCLKVHKVPYLQDRHTVYCCAYTVFVSVSACQRPSCHWR

SEQ ID NO: 786610 - protein, 143 aa, Homo sapiens
MRENHRSKGFSQSQALPLLMCPASMPTSILTDTLLPPDHIVSHILAFTNTGLCLECSFSIWVLKTQNGGENKQHLCPEELKRFLSLFGKLLCILQNPAQLSPPPESSPIALLWILLKHPPATLSYCDVRSWPVFLQGGLEKEA

SEQ ID NO: 786611 - protein, 72 aa, Homo sapiens
VCALCGVPALCVVHGVCALCEVPALCGVCGVCALCGVPALCGMRGVCALCEVPALCGVRGVCALCGVPALCG

SEQ ID NO: 786612 - protein, 262 aa, Homo sapiens
EDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRMDRLLPHMHNIVEYMLQRTQDQDENVALEACEIWLTLAEQPICKDVLVRHLPKLIPVLVNGMKYSDIDIILLKGDVEEDETIPDSEQDIRPRFHRSRTVAQQHDEDGIEEEDDDDDEIDDDDTISDWNLRKCSAAALDVLANVYRDELLPHILAL

SEQ ID NO: 786613 - protein, 86 aa, Homo sapiens
LVTELSAHNTVPLFSVYNKGQPRGELKRVRNNRQTDDPGARSGRRAGARSGSAPQVSGTSCLQLKGTVNREAPVNPQATVDPQATV

SEQ ID NO: 786614 - protein, 125 aa, Homo sapiens
MSQLVSFPSALSFPNTLSTAQPNTTTSKTFPFVGMKSGILNMDSKACYFPFLVLFSASSPIILQSMCNCPLCTLNSTICTFSNVVMSRTLHFPTLHMLLPLPALSIILLISIHTVGFSASSMNHS

SEQ ID NO: 786615 - protein, 191 aa, Homo sapiens [sequence omitted]

SEQ ID NO: 786616 - protein, 248 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIAQEEQAVLTRRDPGGFQVNGTGPLLVPGPRLGATGRVS

SEQ ID NO: 786617 - protein, 129 aa, Homo sapiens
MEPNHPFYSNISKDRRYADLTEDLLPSCESLKDTIARALTFWNEEIVPQIKEGKRVLIAAHGNSLRGIAKHLEGLSEEAIMELNLPTGIPIVYEWDKNLKPIKPMQFLGDEEMVRKAMEAVAAQGKAKK

SEQ ID NO: 786618 - protein, 68 aa, Homo sapiens
GPQGVQNGLWVQPCCPRNQAGSRGWEEARAWPSGGLTCEPHGERQHPDKVSLPWRPGPCRGDRCFSHA

SEQ ID NO: 786619 - protein, 370 aa, Homo sapiens
KKGCGYVQLTHCMNCACGMPKDKAIKKFLIQSRAWWLTSVIPAILEAKVRGMHETQEFENSLDNMGIFNQFQCSSEKVLPSDTLRSALAKTFQDEQRFQLGIMDDAAECFENLLMRIHFHIADETKEDICTAQHCISHQKFAMTLFEQCVCTSCGATSDPLPFIQMVHYISTTSLCNQAICMLERREKPSPSMFGELLQNASTMGDLRNCPSNCGERIRIRRVLMNAPQIITIGLVWDSDHSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGEQP

SEQ ID NO: 786620 - protein, 147 aa, Homo sapiens
KLSAMCRQCSTDYHDVYVSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGEQP

SEQ ID NO: 786621 - protein, 189 aa, Homo sapiens
MLERREKPSPSMFGELLQNASTMGDLRNCPSNCGERIRIRRVLMNAPQIITIGLVWDSDHSDLAEDVIHSLGTCLKLGDLFFRVTDDRAKQSELYLVGMICYYGKHYSTFFFQTKIRKWMYFDDAHVKEIGPKWKDVVTKCIKGHYQPLLLLYADPQGTPVSTQDLPPQAEFQSYSRTCYDSEDSGEQP

SEQ ID NO: 786622 - protein, 152 aa, Homo sapiens
RGVWSGQPIRRAVPPRGMTLGPMGRALHSVNAVGRGSEKRELSGSRARLMCAQGRGKERAKFLRRTAGMCGRNSLSTAPLIPTRLLRERLGPARGYPATPNSTAPRDPPPPITPSVGFQCLKKDALFKKARSFCSIFPSSVSLFAFSHLPKP

SEQ ID NO: 786623 - protein, 111 aa, Homo sapiens
CPGFEGLYPSHANGRFDCDFFRIHHPRLNQMFVVSSEQSRTIASSFWDLSLCTPAIKFLAPILLTHIGLAVNQNLRVFLISAPPEHFYPFLCFSANFASGQLRIDLGPLTF

SEQ ID NO: 786624 - protein, 160 aa, Homo sapiens
MPSIYKSVTINTSKEMMCFSDFPVPDHFPNYMHNSKLMDYFGMYATHFGLLNYIRFKTEVQSVRKHPDFSINGQWDVVVETEEKQETLVFDGVLVCSGHHTDPYLPLQSFPGIEKFEGCYFHSREYKSPEDFSGKRIIVIGIGNSGVDIAVELSRVAKQI

SEQ ID NO: 786625 - protein, 136 aa, Homo sapiens
CCVGQAGLELLTSSDQSTLASQSAGVTGMSYCARLAITSTRHLSGFQALSAGGALSRQQLSQERGLVRSPCLRCERLRLRTRIRHCRRLYWNVALNWTDILWMGRERRYCDPILQKWKVKPRGRRGGSAAELEPVD

SEQ ID NO: 786626 - protein, 115 aa, Homo sapiens
MEVLTVLPRLECSSMMIAHYSLKQSSCHTSRVAGTTGVCHHAWLIFLFYFILFFVEMESHYVAQAGLKLLASSDPPASVSQIVGMTGMSHCTWPKSFCLLVLFFEMDFHSSPRLQ

SEQ ID NO: 786627 - protein, 47 aa, Homo sapiens
MVLSTCPCCGQAALRTKVGKTPCHPLGIIPGNLGTPKNCCIMLCPKP

SEQ ID NO: 786628 - protein, 109 aa, Homo sapiens
WQPSVNLLVLPPVLFHSCRKLEKQTLLAVCCPGSRHSLHYSLAQSAAAGLGMASGGRWPLSPSPGKGQQQGDASWVCTEKSTVSLTPRSLTPRSLTLTSLTPPSLTPFS

SEQ ID NO: 786629 - protein, 37 aa, Homo sapiens
MGSLYEPNSNGEIKGSNPVFRAKNTGLSESIKAYLGR

SEQ ID NO: 786630 - protein, 37 aa, Homo sapiens
GKLVILKSGYQQDNCQHSDPKTLEQWRISTSTKNTFG

SEQ ID NO: 786631 - protein, 118 aa, Homo sapiens
SLRVRSCRKKSARPAAGVGDTGIEDANAVRGSASQGPLTEPWAEDSPPDQPPPASARSSVGEGELQYASLSFQMSVILFYFLCILFFFLFVYFLGINSLWAQTRVRRVLRPLCIVKET

SEQ ID NO: 786632 - protein, 72 aa, Homo sapiens
ACALWRPPGHSILEHPKSLMLAEEAQFAATEVKTKKILVSFGSTRTGREVDVCLVSLALRLGLVCLWPLCSL

SEQ ID NO: 786633 - protein, 69 aa, Homo sapiens
IRESNNCYFNVFPAQPHLEWLYSSDQVHQASVCLGSTPSSGSHHVSLGQGELMCVSVSSSVTWKCHVSA

SEQ ID NO: 786634 - protein, 67 aa, Homo sapiens
DLFNLPSDSLKDTTGYHCHFTEEETQALRSKFPQCDTVKGRKWCSNSGNTAPESILLPSALAFSLDG

SEQ ID NO: 786635 - protein, 116 aa, Homo sapiens
GRAFKQYQSALRESTQWSRWHFNKADSCLLACMSASLQPGESLLSLWESLLEAYWLQDEVSFSIFFFFFAKISLKLVNVRNESEALLRNMKGGVQARERTKRVEVLERWDKSMVEG

SEQ ID NO: 786636 - protein, 58 aa, Homo sapiens
RGGKRRQQWTGNPKMVKNRYSGSDSSGWKWKRLWLGTSKEVQMLLIRFPVWPRSGRLM

SEQ ID NO: 786637 - protein, 70 aa, Homo sapiens
YRLRLSPFWAVETPTPGSPASYGLLTAPLLLLFSSSSHECALASWSDLARMPSNAGPLNLGFRSLQTCKK

SEQ ID NO: 786638 - protein, 113 aa, Homo sapiens
IPPLRFHCHCPDPSSHHHLLPGSCNSLSHNWYSCLHLCSLESSLYTVARTIFWNKSDFILSLLKTLQWPLTVLGIKSKLFITTYKIFVLIYRFFFSTPAQDGVLLCCPGWSAV

SEQ ID NO: 786639 - protein, 71 aa, Homo sapiens
SWRRASGCWGVRDDGESGARPSRGDTAFQELSPGKLTDIFKEPSWTFCFLLLITGFGINNIQQPGHCGSCL

SEQ ID NO: 786640 - protein, 142 aa, Homo sapiens
SWRRASGCWGVRDDGESGARPSRGDTAFQELSPGKLTDIFKEPSWTFCFLLLITGFDGVSLLFSRLQYSGVISAHCNLHLPGSSDSPVLASRVAGITGTCPHSQLIFVFLVVTGFHHIGQAGLKLLTSGDPPRPPKVLGLQA

SEQ ID NO: 786641 - protein, 124 aa, Homo sapiens
EELDLSPSLEDDSCKNGWRAFATVAGEQEAGHLWDCATSLERESLLAGVPRHTGCCLQRATDSSGPEPVQGVAVQDLRGLSSVSLQKSRSESYLGIPVVWPFLLWCCELGRSWPHIHNRARAPV

SEQ ID NO: 786642 - protein, 107 aa, Homo sapiens
STWWPATWTYSLTGDVNSHHWAKVISAKFLHCKLTLFPFVVKKCLAERQRWLESLSRLQLSPKRFVSTDSDSILNFLVAVAFLRLCEILNVQGKSLCLRSPFLLCLS

SEQ ID NO: 786643 - protein, 121 aa, Homo sapiens [sequence omitted]

SEQ ID NO: 786644 - protein, 133 aa, Homo sapiens
FSPHHRSAKTQVFYCVFPQPRKLGLWKPKTQMNAPSSVARATKPSCLTWGKLKEIDSRTSQPSEPQVPALHTVPGTCMKKLRPSPAVCPASSLCLSAHPQAHGGWLPDSRLRQARGETENCWEISIIYIPETK

SEQ ID NO: 786645 - protein, 146 aa, Homo sapiens
TKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPT

SEQ ID NO: 786646 - protein, 38 aa, Homo sapiens
MPWLKCHPIQETLLSGTKWGPRCSEVSSEIFLKQLTKN

SEQ ID NO: 786647 - protein, 114 aa, Homo sapiens
MRSRPQQGTPHPLSCLSGDHTAHSLPTDGKSRCLSEASSGDGSLLLTPLELTQGRGPEPGETSPRDPLKSSLCFLRRGSGLPLKLPYSLRRRRLDPTPPQSFVLLKTCGFQTDE

SEQ ID NO: 786648 - protein, 34 aa, Homo sapiens
MVYHMGPWSRHRGESPPFWPGAITPGTIEKQSNT

SEQ ID NO: 786649 - protein, 48 aa, Homo sapiens
PTCEAMVCQGEFSGLDQREQSHAGKSESLWKAAKVTAGNKTVYSKSEG

SEQ ID NO: 786650 - protein, 416 aa, Homo sapiens
MVDHLLPVDENFSSPKCPVGYLGDRLVGRRAYHMLPSPVSEDDSDASSPCSCSSPDSQALCSCYGGGLGTESQDSILDFLLSQATLGSGGGSGSSIGASSGPVAWGPWRRAAAPVKGEHFCLPEFPLGDPDDVPRPFQPTLEEIEEFLEENMEPGVKEVPEGNSKDLDACSQLSAGPHKSHLHPGSSGRERCSPPPGGASAGGAQGPGGGPTPDGPIPVLLQIQPVPVKQESGTGPASPGQAPENVKVAQLLVNIQGQTFALVPQVVPSSNLNLPSKFVRIAPVPIAAKPVGSGPLGPGPAGLLMGQKFPKNPAAELIKMHKCTFPGCSKMYTKSSHLKAHLRRHTGEKPFACTWPGCGWRFSRSDELSRHRRSHSGVKPYQCPVCEKKFARSDHLSKHIKVHRFPRSSRSVRSVN

SEQ ID NO: 786651 - protein, 205 aa, Homo sapiens
AGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYVPQCDAFGSWEPVQCHAGTGHCWCVDEKGGFIPGSLTARSLQIPQCPTTCEKSRTSGLLSSWKQARSQENPSPKDLFVPAC

SEQ ID NO: 786652 - protein, 57 aa, Homo sapiens
MLYRGRDSDWGSLSTWASVSPTVKSRHLPHRTRCGACDQMSSFLSSVSQLILGRCWH

SEQ ID NO: 786653 - protein, 32 aa, Homo sapiens
MSPSSISSPLLKTCWRSKHICFLSPGTNYKHI

SEQ ID NO: 786654 - protein, 45 aa, Homo sapiens
TVAYRKEVHTHPNVHTKCNKEVSSETQSTPKRLFSTLPPPEQAFR

SEQ ID NO: 786655 - protein, 1551 aa, Homo sapiens
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSEFPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 786656 - protein, 1551 aa, Homo sapiens; identical to SEQ ID NO: 786655

SEQ ID NO: 786657 - protein, 553 aa, Homo sapiens
MSTARGQAWTALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTGRAWVSLGGSPGPPAPADFPSYESPPLCWHLPLMSFSIRMELAWARV

SEQ ID NO: 786658 - protein, 726 aa, Homo sapiens
MVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTGRAWVSLGGSPGPPAPADFPSYESPPLCWHLPLMSFSIRMELAWARV

SEQ ID NO: 786659 - protein, 347 aa, Homo sapiens
MYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 786660 - protein, 344 aa, Homo sapiens
MEGLRPELALYSAMGIARSEQSSFLHLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 786661 - protein, 344 aa, Homo sapiens
CAYTIELRYLNHSSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSEFPQKYYWWFFQTVPVPATQEAEAEESFEPGRQRLQ

SEQ ID NO: 786662 - protein, 163 aa, Homo sapiens
MKTVRGRPVVSGSRPGPTAPNQLSVLCTDPRLPAWAPSTDYAFAAHHTGITDTTRVGIILSRGTAASISFMFSYILLTMCRNLITFLRETFLNRYVPFDAAVDFHRLIASTAIVLTGRAWVSLGGSPGPPAPADFPSYESPPLCWHLPLMSFSIRMELAWARV

SEQ ID NO: 786663 - protein, 726 aa, Homo sapiens; identical to SEQ ID NO: 786658

SEQ ID NO: 786664 - protein, 726 aa, Homo sapiens; identical to SEQ ID NO: 786658

SEQ ID NO: 786665 - protein, 683 aa, Homo sapiens
CAYTIELRYLNHSSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSEFPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 786666 - protein, 373 aa, Homo sapiens
CAYTIELRYLNHSSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSEFPQKYYWWFFQTVPGLTGVVLLLILAIMYVFASHHFRRRSFRGFWLTHHLYILLYVLVRAFGCE

SEQ ID NO: 786667 - protein, 482 aa, Homo sapiens
MVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGGAAW

SEQ ID NO: 786668 - protein, 108 aa, Homo sapiens
ALSPYFTPLTTLLCSGCPVMHYDKNESGSQAQWLKTGNLSNLGGPGGRVTWAQKFETSLGHIVRSHLYKNLKIKKMSLAWGLCLWSQLLGRPGWEDHLTLGGGGYSEP

SEQ ID NO: 786669 - protein, 58 aa, Homo sapiens
REQRSQMGLEVQAGDQPVPRPHRGVLHQWQNTDVWMVVYTHGIQNVPNPNRKHNPARV

SEQ ID NO: 786670 - protein, 103 aa, Homo sapiens
MEVPHQGGGSLSPAELPWTLFFPRWLGRGWLSWDSASDGCPQPTAGARRDLSPLPVMGSCRPFGALLERWLPDLQLFLEGQGCPLLVVCSGWPCLTALCLSGH

SEQ ID NO: 786671 - protein, 55 aa, Homo sapiens
HRVPDLRSHRAFLKPSMRVTALRNVLSTPNSGSNLRQCYPSSLRGTHSAGTAAPF

SEQ ID NO: 786672 - protein, 72 aa, Homo sapiens
VLVWFLGPHVIYCRNQAGNPKGTNQGLPKAWAFVAATDQRDLARAAGCPHVAATDHSVVICVRFSTCRPKVE

SEQ ID NO: 786673 - protein, 72 aa, Homo sapiens
RQNNPSELQFSGGLEELANSAISPLRTGRACELDNTKITSCLSSERNRLMKLQIKLHLALADPALCCQGPSS

SEQ ID NO: 786674 - protein, 71 aa, Homo sapiens
ENVGVTVMDGSVLFYDAVSHTWYGVAIATPYTDTQRHTVTNHRHKHTATHRHTQSHTQTLKSMEIHTLLSS

SEQ ID NO: 786675 - protein, 67 aa, Homo sapiens
MPGTQNSQIMSKKNKTGGFTDPDLKACYKATVIKMVQSRRRADVWTNGIKRQVKKQGMMSKAIQWGK

SEQ ID NO: 786676 - protein, 196 aa, Homo sapiens
MGGCFECQEAARGAQCPGLCHPRWLFGWSVFGERVEGSRVQGGLGLGLLTALWRCTEGHPAGEQPGGIGTCSHRGVFALPICFTVALDLCASWKIEAEPIPLGDLEIISGKGCLCPRLKMTCPCTLSAPGFPHRPLQPRGLTRGSTHGQVWPDLARVGSWASGSPNGGLLRVSGGSEGCTVPASAIPVVILLSVLI

SEQ ID NO: 786677 - protein, 178 aa, Homo sapiens
MGGCFECQEAARGAQCPGLCHPRWLFGWSVFGERVEGSRVQGGLGLGLLTALWRCTEGHPAGEQPGGIGTCSHRGVFALPICFTVALDLCASWKIEAEPIPLGDLEIISGKGCLCPRLKMTCPCTLSAPGFPTLWGGESVRVSAGFEAQLCCVKIERSPPDHMDRTHRLLGGPAAPVT

SEQ ID NO: 786678 - protein, 102 aa, Homo sapiens
GRNSGLYWEGVRKEREEDGDIRGRANEPCSATALAFNLCKFSEITLQKQCQAEDTVALEEMIMDISSTQLHTQKLQLPYTRSSRYGGSLPTPYHTDSSPYSP

SEQ ID NO: 786679 - protein, 80 aa, Homo sapiens
QSRHGQGFLWLSDDDGHLGEGTKMAGVGDTFIPPTAIDLVSTRSWARAKVISQTCLQILFSLWKDVDIARKLLYSPGSEW

SEQ ID NO: 786680 - protein, 393 aa, Homo sapiens
DPPANVFSVNPNQHTRSSACTYGYSAGLSLNGNDFRHVVLADGATIVAYPISNAISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSDFSPSDFGDRA

SEQ ID NO: 786681 - protein, 119 aa, Homo sapiens
PQTETHTLSPSGSGKTFTTALISNATPLPVTYASSASTGHTTPLHVTDASSVSTGHATPLPVTSPSSVSTGHTTPLPVTDTSSESTGHATPLPVTSFSSASTGDSTPLPVTDTSSASTG

SEQ ID NO: 786682 - protein, 458 aa, Homo sapiens
DTGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSDFSPSDFGDRA

SEQ ID NO: 786683 - protein, 105 aa, Homo sapiens
MLEVFGLWEERSQAALWFEYVEILGLHSPAAVERGWQTAVKLMLLNEIELILMDKLVLSPEEHELPVFEYVYVCSSRIIVLWLVVPESSSLFRLHRIFSWPLTLR

SEQ ID NO: 786684 - protein, 157 aa, Homo sapiens
CAPYSVKGEVGQDPVSFDTIERWREGFSVAPSPLLPDPCLAGQGLENLPAGPPRSSLLAPRSSLSSLMPFPLAEPVRLPAQLPTDKILEGPFNISESWPISVMNFAQACAKRAANANAGFLKEYELLLQAIKDEAGSYAPLPGYEQDSPISWWALWL

SEQ ID NO: 786685 - protein, 46 aa, Homo sapiens
MRSLDPLLLRLVPHWPFKKSPRPQQQNVFDGRDCCPLWFSLFLMLM

SEQ ID NO: 786686 - protein, 39 aa, Homo sapiens
MTILYHCKFLPVREKPYDLGGKVSMTCIAMYSTRGRRQL

SEQ ID NO: 786687 - protein, 129 aa, Homo sapiens
MVCTVKSVRLSDSRDPSLPTVPHWLKGQNGAVLELQVRGHLLLLFVWIQPVAGCSGCIWVVGVGEPELRLLTELRLLTELRLLTELRLLTELRLLTELRLLTELRLLSPTVAAAPHCREPLRYLWTEKP

SEQ ID NO: 786688 - protein, 119 aa, Homo sapiens
ARIRECSDGMQLKRRSFKQQELTVCHDLRETERGTEIGRNRDIERSRDRKRETETERERETGRQRETKTDREIWESGHLSLFLLEPQATFLISPELRCLIWATFLTHDLLPLCEGDLKS

SEQ ID NO: 786689 - protein, 83 aa, Homo sapiens
ATLHLALLFQYIALCLQTGKTSFCLYQWDLPLPLEQILFSNSDTTKSKNAPSLIHLLSTELKPAFKGTLKRKLLKIENVDPPQ

SEQ ID NO: 786690 - protein, 88 aa, Homo sapiens
MGTGAQTPLSAAQNADTRKEEKYPKCPSFGFKKSTSLNKVRDASVQSSSIHNSKDMESTHVSISGRMDKENVVHAHHGILCSHKKEQN

SEQ ID NO: 786691 - protein, 691 aa, Homo sapiens
ALHARSRQTAAPASVPAPAGAREPRGQRRSGQRTISRALALCAPGQLSPGHPLSKMKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALLVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 786692 - protein, 71 aa, Homo sapiens
LKESLKEVQLERDEYAEHLKGERARWQQRMRKMSQEVCSLKKEKKHDKYRVETLERSLSKLKHQMGKMGLA

SEQ ID NO: 786693 - protein, 104 aa, Homo sapiens
LKESLKEVQLERDEYAEHLKGERARWQQRMRKMSQEVCSLKKEKKHDKYRVETLERSLSKLKHQMAEPLPPEPPAVPSEVELQHLRKELERVAGALQAQVEYNQ

SEQ ID NO: 786694 - protein, 67 aa, Homo sapiens
ACRFLGFGVLIGFWDLRFLARRVPRLPAGEVCLSSVLPGAVGVENLDPAWASEGPGNDWASSRSRLY

SEQ ID NO: 786695 - protein, 169 aa, Homo sapiens
RLKFFIVESFFRKAIKCKIRFDVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPN

SEQ ID NO: 786696 - protein, 269 aa, Homo sapiens
MEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPN

SEQ ID NO: 786697 - protein, 294 aa, Homo sapiens
MASAPAEAETRQRLLRTVKKEVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPN

SEQ ID NO: 786698 - protein, 99 aa, Homo sapiens
NALTGYDWHPSRLAVYSFNNFCVCVPRWMSVWMGVWGVCMGCVHMCERMCAQVYECVDRCMCGMCAWSVCTCVSVCAPTWMSVWMGVCGLCMGCVHMCN

SEQ ID NO: 786699 - protein, 165 aa, Homo sapiens
GRSTRIPMQRTRSARPSGLASVASHIDVTLELLPQTGRRDRLSPHLPPYSPLYSRFDHLSPSAAPSHFGQSQAPIRLPPPPGAPSISLSPLPQNLCKGYERDPLPSRPPLRAVRSKKQKLVGGWLGLCPVPRWINCLFSHPLLVPDLLCPRGQTHCAVFCQSVAQ

SEQ ID NO: 786700 - protein, 71 aa, Homo sapiens
MPDVFILGNPTDYHLWAPFLDEEGPFPEGDIPQFPEGIQMFTSTHKKNFWPGAVVHTCNPSTLGGQGGRII

SEQ ID NO: 786701 - protein, 114 aa, Homo sapiens
MAAYKLAADPAWRAAWNLADPLQQLIRLRPEPGRPPRKVNAQAGKELHKMSAMRSDILLHLQSHEETRPDPPGTGLRMPLIQMWPTCLCGLGRLMNGTYGGSARFRQAKRWTPA

SEQ ID NO: 786702 - protein, 104 aa, Homo sapiens
GRRCWVHRTKGPRPNPSPSFRMTHLGWGPLPREGGQPSIPSPGATQPAPEGGGREKGHLGAKTSCRILRLSPHFQDIVSHQGHSSPHLLPQSPTHLPFTSLQSN

SEQ ID NO: 786703 - protein, 104 aa, Homo sapiens; identical to SEQ ID NO: 786702

SEQ ID NO: 786704 - protein, 216 aa, Homo sapiens
TPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSK

SEQ ID NO: 786705 - protein, 77 aa, Homo sapiens
CNFWNKHSCVCFSTQRSRQNGSLARRVQLEPRTLGQMPSGSRENTPPAGHWELSCRRICKEANSGPLRKQVMRPQRC

SEQ ID NO: 786706 - protein, 91 aa, Homo sapiens
DWPFYEILTPVKKPGPRSPHLGSHSVLGTVCTLCGIVYVGSISGNGSLYWPGITRISPNSFNNAKSEHNRWSHLIHTTDLEDASFIINPTT

SEQ ID NO: 786707 - protein, 38 aa, Homo sapiens
EECWGRSFSLQDTKAISELQTEVRYVTVIPRARVRITQ

SEQ ID NO: 786708 - protein, 43 aa, Homo sapiens
MDARPMTTRCQNCTLVRGDGPTACGYTPRPATQHSPPCNPSRA

SEQ ID NO: 786709 - protein, 66 aa, Homo sapiens
SSRYLLFSMEMFPLSFSDCSLLVYDDDTACLLPSRNLRMRYNSMKNHLLVCNKVFSQSVNQFSRAA

SEQ ID NO: 786710 - protein, 42 aa, Homo sapiens
MAVGAPVALVFLLFQGGSHHGHFPHCSTADSQHSPEFSREVL

SEQ ID NO: 786711 - protein, 113 aa, Homo sapiens
LYIHYLIYPIKKLANLDLNPILQMEKLICECFVSPVGQQNEPTYLCPTNSFLAPEESESLHLSFYLLIFHWLITPQAIFYPYVYIHPSPLFMPLFSISFFQMLPNHVKKRYLS

SEQ ID NO: 786712 - protein, 58 aa, Homo sapiens
AYPDKSLNSSLLQFLHNGHPYTAHLYNGDEIIGRGESEAVDHLRSGVRDQPGQHGKTL

SEQ ID NO: 786713 - protein, 76 aa, Homo sapiens
TIRIELVTPLQASREPLALGSLLQPHWGSWSSAHLGEATTANNNRPFLLPGTAQNPPKCTGFKEVMPFEGFCAVPG

SEQ ID NO: 786714 - protein, 40 aa, Homo sapiens
ARSQKKAPIVTAESSGKRPLASRKSSQLYELQRNAANGLA

SEQ ID NO: 786715 - protein, 71 aa, Homo sapiens
EVEVAVSRLVDATVLQPGQQSKTLPQKTKICCSSQYIIYFRHCNFYLLISSLSFFISSVSVKNFWNVWSTV

SEQ ID NO: 786716 - protein, 58 aa, Homo sapiens
HTHPLTCTHLLTLMHAHACSHTHTHPLTHMHMPAHTHSLTPALMHTPTHMHMPAHTLA

SEQ ID NO: 786717 - protein, 40 aa, Homo sapiens
CQQRRTLHNPGVGSTIPSGLHLHCTVTEIPASAQDTGTSE

SEQ ID NO: 786718 - protein, 48 aa, Homo sapiens
ICKGEVKISLFANDMIVYLENPKDSSKKLLDLINEFRKLSGYKINVHK

SEQ ID NO: 786719 - protein, 418 aa, Homo sapiens
MTLLPRLALREEEARRGPLRAPVQPGLGERSPQRHREPKQGRVSQRWHPAREPLAATGFLHGLGHLGRAAQSPRASCCILWPGTWGDPLRTLGRSQREVQTVCTGVSGDQAQKEQDGHLLAWRKILLPGKKTTPRGIGLGCRTLSQATAPFLLQNWGRKRAFRPGSENPSSGTSRPSRGRLEARSSGLDEAWEAQRLTGHGRFPSPRKEKSLQRGLAKAPVPKQRKGACLQTPPAGSLPRPPHPARGQSSPWLWQGHTACGWLQASSPERPLPLDSQPGPSVLQATRTWMPRFSETRVLGTYTLLGLLFLPTLSLPVSMATPPNSRFQAAMTSSLPFLPPRPWRYCCLGPGVGVGGLQGFPGPLPYPPGAPPTRDPRPVGHGCASPDSSLPVCPWGQRPSFSRPLGAALREPHSSPAD

SEQ ID NO: 786720 - protein, 388 aa, Homo sapiens
MTLLPRLALREEEARRGPLRAPVQPGLGERSPQRHREPKQGRVSQRWHPAREPLAATGFLHGLGHLGRAAQSPRASCCILWPGTWGDPLRTLGRSQREVQTVCTGVSGDQAQKEQDGHLLAWRKILLPGKKTTPRGIGLGCRTLSQATAPFLLQNWGRKRAFRPGSENPSSGTSRPSRGRLEARSSGLDEAWEAQRLTGHGRFPSPRKEKSLQRGLAKAPVPKQRKGACLQTPPAGSLPRPPHPARGQSSPWLWQGHTACGWLQASSPERPLPLDSQPGPSVLQATRTWMPRFSETRVLGTYTLLGLLFLPTLSLPVSMATPPNSRFQAAMTSSLPFLPPRPWRDPRPVGHGCASPDSSLPVCPWGQRPSFSRPLGAALREPHSSPAD

SEQ ID NO: 786721 - protein, 102 aa, Homo sapiens
LHPLFPPGHSSVMRSMGIRFWRWGRVALGAGGNVRIPAEKTESICDNCNSQHSNYTMFTGLCRVTLLISEKYIYCIRNTGAIPDLHSSLSLILNIIARYKVL

SEQ ID NO: 786722 - protein, 123 aa, Homo sapiens
MGNTQASTGSPLKCILSHWDQFDPQTLKKRRLIFFCTMAWAQYSLSDEEKWPPEGSTNYNTILQLDLFCKREGKWSEIPYVQAFFSLKNQGHQATDGLTNGTFTIPELDINTPIGTLYLAQGL

SEQ ID NO: 786723 - protein, 116 aa, Homo sapiens
RSYGDSAFSFPYMPGSEVSGSHGDSAFSLWYMPGSEVAGSYGDSAFSFRDLPGSAVARSYSDSAFSLLRNCWTVFHSGCVIFHFQQQRVMVLISPHPHQHLLLPFIAFIFHCGHPS

SEQ ID NO: 786724 - protein, 70 aa, Homo sapiens
TLLMLKVFVIPCLIVIKHCHLASILWDQSILKDVKSNSVSAEPTVSAMSCRKETPLNFLILHKPISAADS

SEQ ID NO: 786725 - protein, 34 aa, Homo sapiens
MGSISHPSAVTPMGGECGLGRMKWEDDDEVPIAC

SEQ ID NO: 786726 - protein, 66 aa, Homo sapiens
TGKIVTVHWRNMTNTILNQMMKVNITSDIMQASYTPRYDATRRAPELVVFLLKICNHSQITREATD

SEQ ID NO: 786727 - protein, 120 aa, Homo sapiens
MTTHHTQILPMTRNSSTPKAATLFTFAQLLRIRQFFPILMKIYLSKGLILALPYPFELFRKGSRTAETTICRPLPMYSVSFSLLWHLTLTAMQEVETVISIWLIMGSTELREIKVIWLGY

SEQ ID NO: 786728 - protein, 98 aa, Homo sapiens
KKTNGDGEYGASPLNLLDIGQVRWLKPAITAPCEAEAEVGGLIGPRSLRLAVSYDHATALQPGQQSKTPSHYTYVDKGKREMGSMVRDETEKVNWAQF

SEQ ID NO: 786729 - protein, 98 aa, Homo sapiens; identical to SEQ ID NO: 786728

SEQ ID NO: 786730 - protein, 98 aa, Homo sapiens
DFPGRRFLETLTPGTCEEDESLSLVGQAFSACAVLTVRSPTAIFPGVCARGVHQQQLAALAEVLDSERQMVGAGRAGDGDGPILLVGSIWSTDSPPSH

SEQ ID NO: 786731 - protein, 105 aa, Homo sapiens
MSFFFPFLLETGSCSGAQAEVHWCNHNLLQPSTPQEILLLQPPKALGLQIEPPLLASTCLGPFLLILTAVSIPDWFPLIDFPHPYGLCLSAFVRTWTFFIVYQPL

SEQ ID NO: 786732 - protein, 361 aa, Homo sapiens
MNESRWTEWRILNMSSGIVNVSERHSCPLGFGHYSVVDVCIFETVVIVLLTFLIIAGNLTVIFVFHCAPLLHHYTTSYFIQTMAYADLFVGVSCLVPTLSLLHYSTGVHESLTCQVFGYIISVLKSVSMACLACISVDRYLAITKPLSYNQLVTPCRLRICIILIWIYSCLIFLPSFFGWGKPGYHGDIFEWCATSWLTSAYFTGFIVCLLYAPAAFVVCFTYFHIFKICRQHTKEINDRRARFPSHEVDSSRETGHSPDRRYAMVLFRITSVFYMLWLPYIIYFLLESSRVLDNPTLSFLTTWLAISNSFCNCVIYSLSNSVFRLGLRRLSETMCTSCMCVKDQEAQEPKPRKRANSCSI

SEQ ID NO: 786733 - protein, 107 aa, Homo sapiens
FGGDARKAIFLKGLDVDTSLVSNNCCPLFPDFLGEAFMSPKLRSKSLLSYLTLSLKANLDSSLQNAHFLGQFFTGKSARVQVPFKPCWLGILLTWHKILLLHYDSLG

SEQ ID NO: 786734 - protein, 33 aa, Homo sapiens
MQEMHLEIDSQKQLQQAASQDGPKPPPPRTCLT

SEQ ID NO: 786735 - protein, 124 aa, Homo sapiens
APGHSPTHPPLPGKGQQHNVYALSLSWPWPVQSLWCHHRVPRNSPIPKAGRPRNGHDNELTTWESQGQEGEPTMSPKATLGTSGMPCNYLLTDTHHRLSARSDLATPDKTPRTPDIGSVVLAQV

SEQ ID NO: 786736 - protein, 123 aa, Homo sapiens
RERNTRERKLRTIKTLAAFTMENLYTLLPLDSESKLRGVEWTGFQAQNVAVPDSLFLSSLILKPYNTYKSLRSPLKGIFWVSLYFSPPPNSDSPDVCHRAFQAGIQLLRCASWHFGDTHFGNT

SEQ ID NO: 786737 - protein, 285 aa, Homo sapiens
KSQPLLHEWELQPFRIDNHKPLRPKVELKEKYVTLGIDGKGLDPSVSILIKGEVQKRSPEPVFQTFYDELNVPVPEIPGKTKNLFLQLAKHVAQSLQVTSCHVCGGTVTGDQWPWEARELVPTDPVPDEFLAPKNHPDNFWVLKVSIIGQYCIAREGKGFTHPVGRLSCLGQKLYNGTTKTVTWWSSNYTERNPFSKFPKLQTVWAHPEFHWDWTAPARLYWICGHRAYAKLPDQWTGSCVIGTIKSSFFLLPIKTGKLLGFPVYASREKRSIAIGDWKDDKWPP

SEQ ID NO: 786738 - protein, 125 aa, Homo sapiens
TINMSYLGVSRAILEGAGQAVESECAVLAAQPHRDFIITPGGCLKCKIIIHVPGGKDVRKTVTSVLEECEQRKYTSVSLPAIGTGNLPEHWTDMNHQLFCMVQLEPGQSEYNTIKDKFTRTCSSY

SEQ ID NO: 786739 - protein, 91 aa, Homo sapiens
DLFQSHSPMSLPYRKGVIHLPLYFGLSGIEFYKQAHNRGSSRFQLLIRWREDEDRWCSHSSFDLHPGPSAESERSPVATLLTVINCKIFRL

SEQ ID NO: 786740 - protein, 94 aa, Homo sapiens
GSRAVRATSAKFHFNTDRLVMVTQSTLGEFLGYVCRVASGWEKGKGDHIGATGVLSVNFKGYRLSLNSARSKANALSKLSDGKEVENKVFDNTR

SEQ ID NO: 786741 - protein, 33 aa, Homo sapiens
VVYVIYGMIGIIGGTQALLEAEPRGLRNSHWIQ

SEQ ID NO: 786742 - protein, 140 aa, Homo sapiens [sequence omitted]

SEQ ID NO: 786743 - protein, 61 aa, Homo sapiens
MEELSLGKGRLEGATQQVSVGWSSNPGSKSPEAAGATHWPTVRGHTVVPKDVSKAGVRQAG

SEQ ID NO: 786744 - protein, 305 aa, Homo sapiens
MIPRGLSGRSRCAARSTVWLTMWSPRCTLWPPAPTHCAPASHMTGEEKAFETIERDEQCIHPQEAALSIQFISLVCWEAIPNARIELQKWELVTSTKTVSLQQGDQVRLQRLRVAAGTCLMQEEEEVMSWGRILIMDVTEVVPEPSQPLTKNKFRVLYEKEQKGPVTALCTARPPGVGHQPEDFPVKPAGQRADGHGLHGRQAALHPPDDQRQELHPGSRPHEEHLAAVTRRRARRWASSWDAKTLEVYSVDFMVDNTQLGFLVSDHDCSLMVYMYLPEAKESFGGMCLLRWADFHVGAHMNAFY

SEQ ID NO: 786745 - protein, 155 aa, Homo sapiens
MSSSFVPAVRRSSVSFAKHPTTDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIGEN

SEQ ID NO: 786746 - protein, 102 aa, Homo sapiens
MSSSMPPPGRIRSRFPKETTIHGEWVTRHADNRCRGRRGPDLRGENLPQTRLQWVLRTGLRGRQGAAVLRGFCPKAGPIPTRKLTAGPPAGPEGSLGEGQWY

SEQ ID NO: 786747 - protein, 80 aa, Homo sapiens
YSSFLNSMTHRDMDCTPTLADNTCVYALRFHQLEDKLGQEYSKDVLTCWFSLSFETRRYLLICITDPQRHCVRGKPRRII

SEQ ID NO: 786748 - protein, 70 aa, Homo sapiens
KHFSDLKRCFLSSIILGQDRKARTGSGHAHWFLMEEHVCDTLWVLSSFRTSVSYKFAHPWAHFTSTEPQP

SEQ ID NO: 786749 - protein, 118 aa, Homo sapiens
FQVKDRILKNVRLPHEHADFHSASADEIDDDSKCDFFWYCGMRSVHNWKTSTTQRPSIFQMTNTQCCPSTVGSESLTGPEEPACRTTTAWHAWAASQKDTHAALKVTNTPPFPNRLPR

SEQ ID NO: 786750 - protein, 165 aa, Homo sapiens
LQVLRQILELSVTTNTPVPQMQLHTIFTELHVQVCNKAPAQHQYSSQNLMEMVHCFVALARSYPKELMKFFFSQMETNKEAVRVGTLNLIRAIVSADEPRMSIRAIYLAIRVVKNTISDTRSKVRMAILHIIGQLALCGYQERIKGWGLKYLSVQLTLSTYKLVS

SEQ ID NO: 786751 - protein, 67 aa, Homo sapiens
NAQCMSGLREAPILLPAAAISLIQGSNLSAYTASYCTNITFRVSRDMEELESNSSQLWGYQTNHHSR

SEQ ID NO: 786752 - protein, 119 aa, Homo sapiens
MRQQGASSGCGAAQPGLPLKAMPSLPLPPHLTPFSFQFRSADRVQAPACHLLCHRSPCGLSPQLWKWMMVSTSPTRAAFTCQGWDIGKAPPAYGPPILALPNTPRNSLSKSALLLPPPF

SEQ ID NO: 786753 - protein, 224 aa, Homo sapiens
YLLPVLTVLQTGACYKSLPSRNGPLAVIVCPGWKKAQFIFELLGEYSMSSRPLHPVLLTIGLHKEEAKNTKLPRGCDVIVTTPYSLLRLLACQSLLFLRLCHLILDEVEVLFLEANEQMFAILDNFKKNIEVEERESAPHQIVAVGVHWNKHIEHLIKEFMNDPYIVITAMEEAALYGNVQQVVHLCLECEKTSSLLQALDFIPSQAQKTLIFTCSVAETEIVC

SEQ ID NO: 786754 - protein, 74 aa, Homo sapiens
VREQKGWGNINSDSSHAEPEIGKRREGAHCRVPVSSSWGLVTPHCTHSSRKKSRAVMRNDSRRRKCQSPMNNRW

SEQ ID NO: 786755 - protein, 61 aa, Homo sapiens
WWGSPFPSNTRDSGNTRSATPFAKGCKSDVSEAGRAAERESWGRVGSVHFAGSAGGQEPAI

SEQ ID NO: 786756 - protein, 48 aa, Homo sapiens
MPNDEKKCDLKSEEQLIHPGINVKEGSKCYCMFFMQDIRRIYTIILQV

SEQ ID NO: 786757 - protein, 139 aa, Homo sapiens [sequence omitted]

SEQ ID NO: 786758 - protein, 80 aa, Homo sapiens
PQTAPVLWTHSHGWLHICTLGSPTRFTYSDNKEIHFVKNVTYKCHSKPVTGMLTLWKFTKLDIDVSTFCMYVTLKQKFTE

SEQ ID NO: 786759 - protein, 111 aa, Homo sapiens
PASSHMELAVLERTTLSCFQDSAWPVPIPSIFQVLHLDFTFPGRPSLILPHPSWGVRHTVLTTTETLSPPHWAVNAGRAETLPQSQGEAQEVVKRPGAVAQACNPSTLGGR

SEQ ID NO: 786760 - protein, 46 aa, Homo sapiens
SGTIKINDRNLSKALWSLTKGGSKQLWHKCAKRWIEEDVSSVSVRQ

SEQ ID NO: 786761 - protein, 127 aa, Homo sapiens
PTSAYRAAGTTGVHHHAWLLFIKKFFVEMGSHCVAQADLELLGSRHLPALASQSVRITAVSHHTGPKYQILNRIGNCVIEDLVITLPYVLLSNSSQVVCLFPSVSLTSYTVGFSRGSMTRQHHHSGG

SEQ ID NO: 786762 - protein, 104 aa, Homo sapiens
VTFPAFSLMLDMRLFLTCWFVGANRATVCVSFLAPVNFPVEDRFISQPNSSRALLPPTWAFRGRLLPAISEHRSGLVGLKGLPVYWGRGLMTMASGCVAIESSL

SEQ ID NO: 786763 - protein, 686 aa, Homo sapiens
MGNILTCRVHPSVSLEFDQQQGSVCPSESEIYEAGAGDRMAGAPMAAAVQPAEVTVEVGEDLHMHHVRDREMPEALEFNLSANPEASTIFQRNSQTDALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 786764 - protein, 663 aa, Homo sapiens
MGNILTCRVHPSVSLEFDQQQGSVCPSESEIYEAGAGDRMAGAPMAAAVQPAEVTVEVGEDLHMHHVRDREMPEALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 786765 - protein, 203 aa, Homo sapiens
QRYDEKRQAGSCLCSLMGAPSRSLETQASPSVPSEEELYLPGCERGGQHTQLQHQGLLRITVPGLSLGKVPPNCSLLSQRHPAPHCHHLRTTPVPPPRLLWLALAMFLQDPHRHTQGPGEELSPANDQPHEVGSDLILGRPSAPRPWWLPEPMATALTWELRAPSLQDFRCVHHLCKSPLSGPSGLLPPRPPSLAQGQPLAGR

SEQ ID NO: 786766 - protein, 86 aa, Homo sapiens
TSYPTGESGNIKAGLEHLPPAEQAEARLQLVLEAAAVLLISIIQVKQPWRDSFLKGDFTLEGATWPGAVAYTCNPSTLGGRDKRIT

SEQ ID NO: 786767 - protein, 74 aa, Homo sapiens
NDVRKAKRPKLKGSSSYSSQSIFNPDKFIRRAECSQRKAVPRSAIFTRRAKAQVQGGVHCLSNQPPDFRGAQDC

SEQ ID NO: 786768 - protein, 142 aa, Homo sapiens
MISLNSGNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQVGLS

SEQ ID NO: 786769 - protein, 106 aa, Homo sapiens
MAAIPPDSWQPPNVYLETSMGIIVLELYWKHAPKTCKNFAELARRGYYNGTKFHRIIKDFMIQGGDPTGTGRGGASIYGKQFEDELHPDLKFTGAGNSRNGQWRGR

SEQ ID NO: 786770 - protein, 119 aa, Homo sapiens
DTHRYTDTQTHTHTYTGTHTDTHRLTHRHTQIHRYRQTHTHRHTHTGTHTDTHTDTHTDTDIHTHRCTHGHTHRYTHRHIHRHKQTHTDTDTHKHTDAHAHIDTNRCTYGHTHTQTQTD

SEQ ID NO: 786771 - protein, 113 aa, Homo sapiens
RGRWVPQHCQPPVPRSNSRRASAASRQHRAEDLQPAMPEPPPRGGLPRTARASPTGATPCSAEPGPINHPRAEECGGTARDWRVAPPADLVLDPLGEPSWAPQSGGDLENFYI

SEQ ID NO: 786772 - protein, 120 aa, Homo sapiens
MLKINKELKEDVEKLKKKFISKMKIFIKRCKIQKKIFEVEMHNRNEKSTEGIKGRFEDAEERISEPEERTMKMIKSEKQEEDCRKVSRARGPMGHHQAKQHIHCESSKRRQENSKRPPLI

SEQ ID NO: 786773 - protein, 117 aa, Homo sapiens
TFDIWKHVSILHIQNGSKINKDRENTWNGIQAVFQIYNCISDTWHNHTKRGKRTNPDNLSTVLGPVSYILLVGFFFSSYMSVEILKPYLFLLQNSTKLSKCIDGVESQGTHRREMQI

SEQ ID NO: 786774 - protein, 98 aa, Homo sapiens
LGQPGAGRGGHDDRMSTGLRGVKGICLDHANVWEGRAASGSGEQPGCGLQTRPQQPAWGARPEGPWLSGSLSSLCGLLRGCQGKEVPWGMSGRQSLKC

SEQ ID NO: 786775 - protein, 84 aa, Homo sapiens
MELTGAGDKWEPCPFQAGAGAPQVPLQPFIPRLQAWASHSTERAGAPPSCEEVAPAQVMAADLSLPVLFGGWEQAGALPFQVQL

SEQ ID NO: 786776 - protein, 107 aa, Homo sapiens
MLQGGGHGPSYPYGKHLDWIFRSGTVFLSTRLAFSTELSREGQGWVSKCRGGLRRVRQAELGTRPPKVSVFHSSRCLFTFNDTFPLSFLPWITSGKGFKELCHILTP

SEQ ID NO: 786777 - protein, 69 aa, Homo sapiens
FLLLPLPASAASCFCRFLLLPLPASAASCFCCFLLLPLPASSLPQALCSSFLVNVSSRSSPPESRFFPA

SEQ ID NO: 786778 - protein, 36 aa, Homo sapiens
MAGSWGRKQAEIKFLCWGPMRVKGEDSKKEHGAHGR

SEQ ID NO: 786779 - protein, 578 aa, Homo sapiens
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGRACIIFTSSTSTTTSSSLASCEHRGTCPALVSGCEWHEPRGLAQLHPEFPKRNFEESQTCDHSAPKIG

SEQ ID NO: 786780 - protein, 518 aa, Homo sapiens
AARVDSGGGGTGRAAGVGASGSYLASLGGGGRASRDGLHGEAASRQGAAGRHGAADSSHRGEPEPAVPHEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGRACIIFTSSTSTTTSSSLASCEHRGTCPALVSGCEWHEPRGLAQLHPEFPKRNFEESQTCDHSAPKIG

SEQ ID NO: 786781 - protein, 578 aa, Homo sapiens; identical to SEQ ID NO: 786779

SEQ ID NO: 786782 - protein, 561 aa, Homo sapiens
MAFMEKPPAGKVLLDDTVPLTAAIEASQSLQSHTIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGRACIIFTSSTSTTTSSSLASCEHRGTCPALVSGCEWHEPRGLAQLHPEFPKRNFEESQTCDHSAPKIG

SEQ ID NO: 786783 - protein, 628 aa, Homo sapiens
MAPAGPWRLSVMLRVLGGGCGLGRGLGSLPVVSDQRLSAGRASRDREETATKRGGSEQQDETAALQPRYHGRDHQETNLEAPLQEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGRSCTTFTSSTSTTTSSSLASCEHRGTCPALVSGCEWHEPRGLAQLHPEFPKRNFEESQTCDHSAPKIG

SEQ ID NO: 786784 - protein, 60 aa, Homo sapiens
PLDPIPLSAVDSIFDTLIIFRLTYPLSCLFLINVNFILEDEFHTHHLTSIGETVRINTCF

SEQ ID NO: 786785 - protein, 78 aa, Homo sapiens
QQISAHGRSSSNVNGGPELDRCISPEGVNGNRCSESSTLLEKYKIGKVIGDGNFAVVKECIDRSTGKEFALKIIDKAK

SEQ ID NO: 786786 - protein, 83 aa, Homo sapiens
SSKKKMPVSKYSYFHVSEGQDIHLTIIYLLCNIGCKLGAGNQMVNKVDMSLLLEISQSKVNRQVQYHTSAIDRKRKDSIQRMH

SEQ ID NO: 786787 - protein, 118 aa, Homo sapiens
MLARMVLMSGPRDPPASASQSANESFEEGCLFLAALRFFLSASEVAYSTYGLHLQSGLILFKMRQVDAELHQPPVISTQCVLEEETLHWACDQRKLNQCWRHILTVEWAAHRRCSNLL

SEQ ID NO: 786788 - protein, 137 aa, Homo sapiens
SGQKVRFLLLLPTAQQFSKHQCFSDYPYQFPFCRRQGLPTLPRLASCGPLALASHVAYATTPSSGLADLNRPYPEVCPQQFLLIHSPVFTFWEINMTAQISSTNLHFYPKLYSRGTRHTQCLAQGVAYINVSHTNRN

SEQ ID NO: 786789 - protein, 110 aa, Homo sapiens [sequence omitted]

SEQ ID NO: 786790 - protein, 105 aa, Homo sapiens
CTLPSPPSGLDFFDIQRGRSLSCSCDTGNFIVGSSLGMKAHPGLAPRCLMPSPAVLLLMASTAPNETLRGTSLLHLLSPSPFPSVAWLHLQLDLIENGNILSVGG

SEQ ID NO: 786791 - protein, 69 aa, Homo sapiens
RIPMAGEEPHHKGAPPNGQEAYENMFNLISQQGIQIRTTPGWLKVQRLTISRAGGDAEQLELSYALRKG

SEQ ID NO: 786792 - protein, 117 aa, Homo sapiens
MNYHKFSSLKQHPFNIPRFYRSEVQAVSPGLCSESHKANIKVSANWVLIWGIWEIFCFQFFTVVDRILFLVASGLTSTFCHCQLGVGVGLGLSRLLIFLLMGFPPPSKPQKEHQILT

SEQ ID NO: 786793 - protein, 307 aa, Homo sapiens
GGAGGSSVPGALNQRAAEFEKPAARGSAAAVPSAEVRGGWGAERAGWGGSWSLASRLGPVSTANMSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 786794 - protein, 84 aa, Homo sapiens
NNPLWHNLPSNKPADVPEPKIKVYKEKKANEFEVKGVDFSNYKEVSYKKLILVLEGNHLEGNYCSCYLISILGDEAVTSQLEMN

SEQ ID NO: 786795 - protein, 172 aa, Homo sapiens
QTAFRLSRLPSDSPFSILSLLSSESEQYQWDGNLKPQAKSAHLAGLLLRSPTHYSSCRWPLLLDPSNEALIWLDPLPLEENRSFAPALTEGRGKGLMRNQKRESKTDMKEEDDESEESNEAEDQTKEQKAEERPHEKSKRESKTDMKEEDDEVRENESEAVWRSALDSIMST

SEQ ID NO: 786796 - protein, 98 aa, Homo sapiens
MAACTFGELRLDLVPALCFSVLQGDVLAASEEEKAPIQSPKGVEAAKELYTHLCDVVDKVDGDSVPMEILKQEVRNTLLNGAAIFFPNRQTRRNHLFT

SEQ ID NO: 786797 - protein, 133 aa, Homo sapiens
VPERVSVDGEEASFDDDFILLAKARRKQCFSLRLLFWYSLSKLPPELFINTGILAEKDSPTSKSGKGEQETHRWLGNRSRSQEVCSQEIFLCQCPRVVSSLGRTHQHTNGRKGSPQRPKLLCWGRGFEGSSPG

SEQ ID NO: 786798 - protein, 640 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYF

SEQ ID NO: 786799 - protein, 640 aa, Homo sapiens; identical to SEQ ID NO: 786798

SEQ ID NO: 786800 - protein, 287 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTQSHFYGQTDSETK

SEQ ID NO: 786801 - protein, 883 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFPTDERSWVYSPLHYSAQAPPASDGESTHNFYAAPDPEPSSTSAPAAPEGAAHPAEAQSSGDARLAAPPDLVLPLHGCRRPGPSPTSLPGPRHPGRQPAPVRPTLPSGQSHLSPYLAQRRKHVCAVLGKEQKRHKQTNQREKSPCPLHSLVLCCACLCPEEEARLFAVASGDLSPGGPIGLQRGRLGSRATLPPSTWEADPPALSLGLGASVQDIWPEHRLWGQPSPCQALRPLSSYVPAAVGP

SEQ ID NO: 786802 - protein, 230 aa, Homo sapiens
SGGSLDAAAAAGWNGAARGLQAISGRGREEAAAPEGAAHPAEAQSSGDARLAAPPDLVLPLHGCRRPGPSPTSLPGPRHPGRQPAPVRPTLPSGQSHLSPYLAQRRKHVCAVLGKEQKRHKQTNQREKSPCPLHSLVLCCACLCPEEEARLFAVASGDLSPGGPIGLQRGRLGSRATLPPSTWEADPPALSLGLGASVQDIWPEHRLWGQPSPCQALRPLSSYVPAAVGP

SEQ ID NO: 786803 - protein, 411 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTVFAGLAGEQVSVPACGVSRACRAPAQRVWVPVASG

SEQ ID NO: 786804 - protein, 50 aa, Homo sapiens
FQGDRRTRRRIFFLVVLRVYVYVCAGVEGVYGGEVCKGFWRAGACVGVVW

SEQ ID NO: 786805 - protein, 42 aa, Homo sapiens
MKIKSLKLYLLSLPIKEAEIIDFFLGATLKNEFKIMPVKMET

SEQ ID NO: 786806 - protein, 73 aa, Homo sapiens
QAVEGPRLPACQINISASAAVKGGQPPVRQTLDLGIHTVNRHIILQKASSSGQLLSLWGPQRWNSAFSLKSWL

SEQ ID NO: 786807 - protein, 97 aa, Homo sapiens
KVTFPKPEIKRTSNSSTVVGKVPKYWSNTFKIHRQHYFQSRILYSTKLQIKCLGRKTFSDVHRFKIFTSCESSVIPSVSLMYSTEMEYIKKYEDVRS

SEQ ID NO: 786808 - protein, 97 aa, Homo sapiens; identical to SEQ ID NO: 786807

SEQ ID NO: 786809 - protein, 274 aa, Homo sapiens
IAKCLAQAGLQSDTECTSAVDLWSLGIILLEMFSGMNLKHTVRSQEWKAKSSAIIDHIFASKAVVNAAIPAYHLRDLIKSMLHDDPSRRIPAEMALCSPFFSIPFAPHIEDLVMLPTPVLRLLNVLDDDYLENEEEYEDVVEDVKEECQKYGPVVSLLVPKENPGRGQVFVEYANAGDSKAAQKLLTGGCLCEVVWLHSTAECYRGGSGQLAYQYLDGSFLLSFLGIPFDAGYPSLRGFTYYSRALPAGVHLAGGPAQGDTGPGGGPLPFVGLA

SEQ ID NO: 786810 - protein, 67 aa, Homo sapiens
CMSSPTISKPGELGRWSLPSTFKAAFSGHREQPGTGAGSTVGSGSGFPKGRMPPTGLCELATPWPLE

SEQ ID NO: 786811 - protein, 111 aa, Homo sapiens
PQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREV

SEQ ID NO: 786812 - protein, 153 aa, Homo sapiens
MHGLFDVEISLTVQENAGSISCSMRHAHLSREVESRVQIGDTFFEPISWHLATKVLGILCCGLFFGIVGLKIFFSKFQCKREREAWAGALFMVPAGTGSEMLPHPAASLLLVLASRGPGPKKENPGGTGLEKKARTGRIERRPETRRYQRLRG

SEQ ID NO: 786813 - protein, 89 aa, Homo sapiens
CGTAGSSLTFPEHPGHCSFEALNLVPSKVLYQSFQPWYPWHLGLDSSLWKDGHVPCRMFGHNPDFRYQWHKNVCKRCQISLRGMRWGKL

SEQ ID NO: 786814 - protein, 37 aa, Homo sapiens
ADLDQLTTQLPDPPHCMSPRSVDIAGTVSWSPVDVKG

SEQ ID NO: 786815 - protein, 164 aa, Homo sapiens [sequence omitted]

SEQ ID NO: 786816 - protein, 42 aa, Homo sapiens
MLALASLIPLKAPRYSPPREKAWQVLQHADEALPVRQRLCGE

SEQ ID NO: 786817 - protein, 110 aa, Homo sapiens
SLGCILQPREAESLAELQVKNSLGVSKGAPERDDVILEALSLERDSHHLCSWLEGCTVCMRVCVYVAGTCKAYLISPSISPAAPRLLPRTTPHQQAGGRGNRSERAGPLQ

SEQ ID NO: 786818 - protein, 68 aa, Homo sapiens
LLTTQESGRSGLLNYWWLEVSPGGSSYSMRTAAHYGSRHFFRELIFSQHAAHCLVVLYRFPRRMAAEL

SEQ ID NO: 786819 - protein, 70 aa, Homo sapiens
EQLHYYKKIYRLSGFKKASFLPSQLPLEFCKHYLNLFSPKVSLRSCSLPSHSLIHTSENHDREEHDLVKG

SEQ ID NO: 786820 - protein, 74 aa, Homo sapiens
PSHLSSYLQDFTYWAYNSEGTNLPLILGNLFLHNAVSVQRQKNARRGCGCRSGGGGAIGEQKASCQEKGIGIYN

SEQ ID NO: 786821 - protein, 102 aa, Homo sapiens
MTINSVCQSNSERSAKDEAEACGKSVLPKTDPRHFAGTESAKTKRGLCPSWHHLNSSCPRASHTRLAVFMYHLDRCILSNFLQITSFGVKSALHTGLLIFAL

SEQ ID NO: 786822 - protein, 52 aa, Homo sapiens
ESSSVPDSLSIQKKKARYGGACYLEVEATVIRDHANALHFSLGKGSETLSPK

SEQ ID NO: 786823 - protein, 104 aa, Homo sapiens
MDNIWIYMNSWTIINSLFYIKAEGQMLIPSPLQDSKFLPLNHAGHNCYCQWSSHIYVRCVNQDDVCSGNISTVEDETRRCCSLDVAAHTNSCLTTLGLEAAIPS

SEQ ID NO: 786824 - protein, 142 aa, Homo sapiens
MGPHRLWMCLSACCPAVHAMPGIGPLAQTPVLWRADLHRSGCVAAGAHCGIHFHRLETAPEQHSSLLQGPPVACSPLVSISAHVYLMMQMTTETWAQCGVWMLIGFAMYFGYGIPHSLENNQQPPASSSQTPHENIPSPLLN

SEQ ID NO: 786825 - protein, 77 aa, Homo sapiens
LQHIWHAEEYGRRLAARLKIAFIITFLMKLTHNHCTDGHLSTVGREEQAKCNLQAPLQSPLLLFCMHHILSSITLTC

SEQ ID NO: 786826 - protein, 104 aa, Homo sapiens
TFCSIYRFPRAAQLLIMCIILSITNTSDRAPSAQFDGQEFEAGLVPSIVNPVSTEHTTIGQALWLMPVIPALWEAEAGRSRGQEIETILANMVKLCLYKNTKIS

SEQ ID NO: 786827 - protein, 108 aa, Homo sapiens
MHTCQNSTGSATLRLRFLPFMILGRGAQIRRQEKRKMGLGACPSEDPRESWPWQAPVLSEDGCCINVDSGHGQPFTGQMSRKAQPGHHSGTPSTRHQVNSRALIPCSV

SEQ ID NO: 786828 - protein, 57 aa, Homo sapiens
NFQHAYCILHVLYGHHLLPASARIDLGETWDDRSISKEGGLGGTGRNQEEVRGLQVV

SEQ ID NO: 786829 - protein, 97 aa, Homo sapiens
EGCIKILSFHIGVSFEDVAVPLSQEEWDCLIPAQRGLYKDVMMGTYGNLLSLVGEWLSKLWYIHTMGYDSTIKRNCPDFTTMQYMHVRNLHLYPLNI

SEQ ID NO: 786830 - protein, 109 aa, Homo sapiens
SNYVLQTPGLSTALVKKRHMGQWAQLHRVHAPGDTAGRVALGWCGGAWPSLTLPGLRSPGLLRTDSRAPHPADFCPVLPPGKLPTSSLIAQLDKDPTASSISLLDSKKP

SEQ ID NO: 786831 - protein, 106 aa, Homo sapiens
WGAQTNSNNLSTVSGLKQLKNIGMPSLPTICTWVKEKLGKTSSLQLLCLLKRNKNITMHQKPPLGCFTGRRATYDVHRVLVRFLGVTSSRGLTSSFSWSLAFTILL

SEQ ID NO: 786832 - protein, 102 aa, Homo sapiens
TTPRHPLQEYPDVFFTSFRSQQLPEVYSNVFFSSFRSLPKCQLHLLQVHANVISVRPSLSLLLLQPFLVPFTALFSLLFIVCLPHLNVGSLRAENCLWLMHS

SEQ ID NO: 786833 - protein, 120 aa, Homo sapiens
MPQFPVAFGIMFTYFTLAHKVLHSQASACLFSIICFFPTCTLHFSQVGSHAAPWMGHDALCLRVFLYRLPCEKPSPSAHMVTGSVLEGPLCALALSSFPPGATLHLSCLGLKRAVFFYQP

SEQ ID NO: 786834 - protein, 102 aa, Homo sapiens
SSRMLSYLRLQRTSKVGILSPLYDMGCELRARGSNSQQLVGVCLMIRHHCLRGENREEIKIQLWMEMACCPPCILLQVHCLPKGMSAVPEKSHSVILVKTYE

SEQ ID NO: 786835 - protein, 89 aa, Homo sapiens
SVCSRPQQGRKHPKAEQILMRHKSHTHGLGIILGSVGSLWRVLGKVVTESSLSVLRKTPLGAVGRMVLRRATLGLQDQWNDVKSRNSEA

SEQ ID NO: 786836 - protein, 80 aa, Homo sapiens
PQQIPLYILRSRRPQHGCTVCIHSVDTCVLHNSSFPGLLWPTCEPTFGLPCGLGCEPTFGLPCGLGCEPTSLSVPCCVAV

SEQ ID NO: 786837 - protein, 72 aa, Homo sapiens
SRDFPLPFSGWAVGEARGSPDDRSGPGRDPAESAPFLICCRESRGQGGENGGSFRIRPPRRERMLLIGKAPH

SEQ ID NO: 786838 - protein, 76 aa, Homo sapiens
YSEPVLVNAELRGDGGGNRRAAYFPRLRPVSTGQWVNMTKNRPRTVMQVGLAQRSLVRKGLPWAENYIKSQERSVG

SEQ ID NO: 786839 - protein, 148 aa, Homo sapiens
NWKSHPLLMGMKDDATLASSLAKLQMLSMYLSYEPALPLPGSYPRALRTTCVCTHSRCFSLLELPQAGTMDGVLQQEMYFLTYLQAGSPRARCLQGWFLPRPLSLPCRWPPVLCVLSQSSLCLCLCYNLPFIKGHQSLWIRAHSNSLI

SEQ ID NO: 786840 - protein, 44 aa, Homo sapiens
IPDTLQKWVQWGLWTNQKLLAEGTFSSSNPRLRGLQDSLHPPVM

SEQ ID NO: 786841 - protein, 124 aa, Homo sapiens
VWSQPFCECSGPAGCTGFEKWTPPSPATSQKPSAMRAGRSRRSPSCRDDNRAQRRWLPASCPLPRSGVTQRDSWPEPQAPAQGATAGRPGFIRDAFVPHQVQRRKLARPSLSLKQAPPQPKRSG

SEQ ID NO: 786842 - protein, 41 aa, Homo sapiens
SHSPGAPNACGVLPGTTVDDGVHQDLQRVLACEQVYDLEGM

SEQ ID NO: 786843 - protein, 139 aa, Homo sapiens
LNQSSHLSLLGSCDYRHVPPCPANFYSFGRDGVVLCCQRWSPTPGLSDPPTSAFQNAGIIDVTVPSHVSLQYTFSLLTAPRSHAPASLSSRSFLVSGWLCLLSSVPRYVFPQGSALGILHSLRSLLGRPHSVPGFKTPS

SEQ ID NO: 786844 - protein, 152 aa, Homo sapiens
SICPFDLELKDEDDEDDCFILEKAARGKRPIFECFWNGRLIPYTSVEDFDWCTPPKKRGLAPIECYNRISGALFTNDKFQVSTNKLTFMDLELKLKDKNTLFTRILNGQEQRMKIDREFALWLKDCHEKYDKQIKFTLFKGVITRPDLPSKK

SEQ ID NO: 786845 - protein, 80 aa, Homo sapiens
TTVAMNSVGEACTDMKREYDQCFNRWFAEKFLKGDSSGDPCTDLFKRYQQCVQKAIKEKEIPIEGLEFMGHGKEKPENSS

SEQ ID NO: 786846 - protein, 80 aa, Homo sapiens; identical to SEQ ID NO: 786845

SEQ ID NO: 786847 - protein, 91 aa, Homo sapiens
TTVAMNSVGEACTDMKREYDQCFNRWFAEKFLKGDSSGDPCTDLFKRYQQCVQVSPPASVPRPCILGAVSHHTHRILRGLGLDWKGGEKSQ

SEQ ID NO: 786848 - protein, 113 aa, Homo sapiens
HSHPHMHTHTHAVTHMHTHTHAHPYTCTATHVHTPTHAATHMHTHSHTQCLPCLSPLAFVTQIAGQAQHPRIRDPVCLSLLGPLHSLPAFTSPGRHNLSTPLSLSSQTLFSLL

SEQ ID NO: 786849 - protein, 100 aa, Homo sapiens
PTLSSQSQEYPVIANMPLRGQVTLTTATTWWLHSTDLHSTVQHSTDLQEQGQPLQGLETEGLLKLVLGDLPSPGPAQQSAAEVLPGSRPPAQSSSLSRLD

SEQ ID NO: 786850 - protein, 112 aa, Homo sapiens
YIYCLTVSTSLESKHLLAGFPASGLTRLGWRCQLGYVSSWRLWGRSPSKFTQVIHRVHSQGDAGLSSGLCAVSHRLPLATRGHSQSFPHGPPSVAAYFIEPARSTSRMGLTV

SEQ ID NO: 786851 - protein, 79 aa, Homo sapiens
QRFMQRVKEKEATFKEAEKELQDKFEHLKMIQQEEIRKLEEEKKQLEGEIIDFYKMKAASEALQTQLSTDTKKDKHRKK

SEQ ID NO: 786852 - protein, 102 aa, Homo sapiens
SLATEQDSISKKRKRKMKIITSRHIVIRLLNKDTLIKVTRKKTKRKKKTHDIERNKDKNDSRCVVRNYSRQKTVELKKKVGQSRILYPTQISFKNEGEINTF

SEQ ID NO: 786853 - protein, 77 aa, Homo sapiens
RSPGEESGGVYQLGASTDFAHYPSSSVQYTPCTDVQPTLTTAKAVRGGQVSECVEAIGSLHGRRRHHQKGSWKEFYI

SEQ ID NO: 786854 - protein, 229 aa, Homo sapiens
MYLGIQSQRRKEHQRRFYWAMMYEYADVNMLRLLETFLESAPQLVLQLYIMLQKNSAETLPCVSSVTSLMSLAWVLASYHKLLRDSRDDKKSMSYRGAIIQVFWRLFTISSRVISFALFASIFQLYFGIFVVVHWCAMAFWIIHGGTDFCMSKWEEILFNMVVGIVYIFCWFNVKEGRTRYRMFAYYTIVLTENAALTFLWYFYRDPETTDSYAVPALCCVFISFVAGI

SEQ ID NO: 786855 - protein, 44 aa, Homo sapiens
FHHSSRPDSNRRNPQKNHGAAVDAPLLISSGSRTPGHSFQNTDV

SEQ ID NO: 786856 - protein, 69 aa, Homo sapiens
RSGCRSARSLCVGTAEGIRCVTQGKCAHLSEPPRPSLAKWWSRYPAVRQAGMRGVAGGKLDWSSHSAAG

SEQ ID NO: 786857 - protein, 69 aa, Homo sapiens; identical to SEQ ID NO: 786856

SEQ ID NO: 786858 - protein, 192 aa, Homo sapiens
MGSLGSKNPQTKQAQVLLLGLDSAGKSTLLYKLKLAKDITTIPTIGFNVEMIELERNLSLTVWDVGGQEKMRTVWGCYCENTDGLVYVVDSTDKQRLEESQRQFEHILKNEHIKNVPVVLLANKQDMPGALTAEDITRMFKVKKLCSDRNWYVQPCCALTGEGLAQGFRKLTGFVKSHMKSRGDTLAFFKQN

SEQ ID NO: 786859 - protein, 78 aa, Homo sapiens
QKSSLIAHQKTHRRQKSCESTNVESLLSEFTNLRKYREKSLLASSESPETFSYLTYSVYIKNSEGEKLCKYEKYFAQK

SEQ ID NO: 786860 - protein, 225 aa, Homo sapiens
TFFFSVRNPEGQIKLYSKGADTILFEKLHPSNEVLLSLTSDHLSEFAGEGLRTLAIAYRDLDDKYFKEWHKMLEDANAATEERDERIAGLYEEIERDLMLLGATAVEDKLQEGVIETVTSLSLANIKIWVLTGDKQETAINIGYACNMLTDDMNDVFVIAGNNAVEVREELRKAKQNLFGQNRNFSNGHVVCEKKQQLELESSCRRNHNRRVCLNHKWPQCWLMP

SEQ ID NO: 786861 - protein, 100 aa, Homo sapiens
TFFFSVRNPEGQIKLYSKGADTILFEKLHPSNEVLLSLTSDHLSEFAGEGLRTLAIAYRDLDDKYFKEWHKMLEDANAATEERDERIAGLYEEIERDLMV

SEQ ID NO: 786862 - protein, 111 aa, Homo sapiens
SSTRSRSTYHRLVTVSWFENRRLVNPRVGISGRGGAGPGPLAPSLGLTRRHRNGVSLQDPHRRRDSPNLRSLASNLLDTNLTALKTSERDVGGFLMFLFLEFFFFGWVRTV

SEQ ID NO: 786863 - protein, 70 aa, Homo sapiens
PSLSFTVLLCPSLSSTVHHCPPLSIAVLRCPSLSSAVHHCPLLSITVLRCPSLSSTVHRCPPLSSTVIRC

SEQ ID NO: 786864 - protein, 110 aa, Homo sapiens
MAVPRCMLPKWLLPKWLLPKWLYLNGCYLNGCYLNGCYLNGCYLNGCMAVRGWGVWVEKNVKVYSLVTLITFTVLYNYHHHFENFFITTDRNSLSSNFPTPPKAPQKKKR

SEQ ID NO: 786865 - protein, 35 aa, Homo sapiens
SQHFTQQDYAPHDIQISVAKPEKMDGKMTKILLVP

SEQ ID NO: 786866 - protein, 66 aa, Homo sapiens
QTPTHSSRPNLTHFPYETFTEAPKFNRSHYFCSRNVTAFYVYFYATISKLHYINHNPCFLSSPGHE

SEQ ID NO: 786867 - protein, 132 aa, Homo sapiens
LILFSFPRNVYMEVIIDPRTVFVPANEENQSALGKNCLHAEGIQQLPKKPLPFVSRGFLVSLRLTQDNNCPSPTWACLPCQCYLGGVEETQACFRKADRYTGDKGHVIQPPAIHLESGCLASTIYGHRNART

SEQ ID NO: 786868 - protein, 74 aa, Homo sapiens
RKEIAHPHLYQGHQMKASISSPVIICKELCIAALTDTTYAVSWCPHSFRVMADCQPTIPPSCSLLICSLISPRK

SEQ ID NO: 786869 - protein, 101 aa, Homo sapiens
HGGPPLTGGHHIDAELSADTLIGIAHYSPEFLGSSDSPASASLVAGITGAYHHAQLIFVFLVEKGFHHVGQAGLELLTSSDPPASASQNAEITGVSLASEF

SEQ ID NO: 786870 - protein, 285 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQEAELRHAAELQKKQEELETLQSINKKLELKVKEQKDYWGDRAVQLKEQNQKNVLKKNEKMGIRVDSVSGPVSTQENELGKLVQGDQDTTEQRSSEKRKTEESRSRRWSNEANETLHGN

SEQ ID NO: 786871 - protein, 135 aa, Homo sapiens
SRILKMPLSLCDQASQGCAATPARTLQGPFLKQLRSLSNMGNTGSHLLPRSSGESLSPRNSSQTSEPPGPGLEPLPKSHFLHNCPGVACLTRSPAHCLLVRRSLESKAQVHGPAMESAPVPCAVTVQLSNLEWRL

SEQ ID NO: 786872 - protein, 69 aa, Homo sapiens
RAQACTLGRHCSVIQEPPLSTAGSEQSERETALPGATQQASHRVGRGRSGPHRMSSSLGPQSSSACPSQ

SEQ ID NO: 786873 - protein, 47 aa, Homo sapiens
KDSSCPAGKKDLIFGFNFFKERRKGQRGLFNLSHDNSQSASKSFMYS

SEQ ID NO: 786874 - protein, 135 aa, Homo sapiens
NHPTHTLRSQNYKKTRMPTLTIPIQYSGGSLSQKNQGRKRNERHLKMKKEVKPSVFTDYMIIYLANPKDSTKRLLEVIKDFSKVSGYKINGQKSVAFLYTNYIIAEKQIKNAIPFTIDTHTHTHTHTHTHTQRNA

SEQ ID NO: 786875 - protein, 117 aa, Homo sapiens
TAGWGGAPGLAETFPPPAGSGRRRPSCRNISSQAAMVSRSCRCRCSTASSSCWARSSRGGCGGGLPPSPSPAFPRSTPAASRSPSILLGVVRFLKTVLSQVYISTRVTKQCKIIFTA

SEQ ID NO: 786876 - protein, 83 aa, Homo sapiens
RILLCTILSLHWLFPCTLIYLHGSNYNPYAENSQSPAVSQLSFLSFATSSPLNISTWMSLRNCKLNWLKGDIQSLPNLLFLWP

SEQ ID NO: 786877 - protein, 312 aa, Homo sapiens
KSWPWGKSNGVRRWGRPYLGTSRKLRVGRSPRPLCRGCRRPKRLLCDLDQAPCPLMPQFPLLSTEGLSRTWRAPSSSHSGTPCTCPQGRVLAGLHVAAVPHSGTLCVETAGKVPLEQVSQPPGPGCLGWVIPGNRPVNRFGRRAVFVASLVLTTGPWGPSEGPGLASFPYPCLVLRLLPRGATIGKGPLLGPCIWARLELCDPPHRLAFSMGAGLFSVVGTLLLPGLAALVQDWRLLQGLGALMSGLLLLFWGFPALFPESPCWLLATGQVARARKILWRFAEASGVGPGDSSLEENSLATELTMLSARSPQ

SEQ ID NO: 786878 - protein, 135 aa, Homo sapiens
MELFQSSPRPPLQPVCVCPGLELCDPPHRLAFSMGAGLFSVVGTLLLPGLAALVQDWRLLQGLGALMSGLLLLFWGFPALFPESPCWLLATGQVARARKILWRFAEASGVGPGDSSLEENSLATELTMLSARSPQ

SEQ ID NO: 786879 - protein, 51 aa, Homo sapiens
GVYERIPVIFYTHTCIYTCTYSYTHTCIYTCTYPHTCTCIYTCTSNHTCIY

SEQ ID NO: 786880 - protein, 41 aa, Homo sapiens
GSGIKIVWLLISNTGCREGAVTFKVCSENCYQLRYPAKLSV

SEQ ID NO: 786881 - protein, 94 aa, Homo sapiens
TSHPASSPALLSRLSRNQRSSILYPRGVKKQSPNNTKRQICYFSSHDSQASGSKGTEWSTPRLVQGASGFSPRSGSLKCTSSINDECSWHLEME

SEQ ID NO: 786882 - protein, 119 aa, Homo sapiens
CSEPVVASLYSSLSDRASLSLNQKYLRRKKKEEEEEEEEEEEEEEEEKKEGRKEGRKERKKERKKERKKKKERQRKKGKGGKERGREEGRKGRKERKIKIEDPMLILLNSSKHLKRNLY

SEQ ID NO: 786883 - protein, 77 aa, Homo sapiens
SSNFFIRQQEKRVQAKEELPNTYKPIRCCENSTHYHENSMKESARMIPSPPTRYLPQHVEIIIPGDIWVGPQNQTIS

SEQ ID NO: 786884 - protein, 131 aa, Homo sapiens
MASAGLQLLAFILALSGVSGVLTATLLPNWKVNVDVDSNIITAIVQLHGLWMDCTWYSTGMFSCALKHSILSLPIHVQAARATMVLACVLSALGICTSTVGMKCTRLGGDRETKSHASFAGGVCFMSAGIS

SEQ ID NO: 786885 - protein, 131 aa, Homo sapiens; identical to SEQ ID NO: 786884

SEQ ID NO: 786886 - protein, 226 aa, Homo sapiens
MEALEVDDISPALEVTEEFFSTLDSNLEKAVQQAEVYGIQEVPELVGHEVLSNITDNGAMRNVTSLGKGGMIWDHCKSRLLETKAQNVFPAKEQFMVQRGTTPDNLSWMEQKEASTFNFFNICQRRRDRPRSVNDLLDETSTFKPGHARSRSDITQVDWRVVLKTTPLQQQQQQQPLLQGPHVTRPSFLLPSPNKIEDAQGNTEHKQTFPNILKKGYLEIRKDHDS

SEQ ID NO: 786887 - protein, 69 aa, Homo sapiens
RPDGCSGPSTAADTPVLWWSVMSKSPAPLLRAVRRTKPAPTLPSSVAGAIPLRRVGLLFWVGESGAGGP

SEQ ID NO: 786888 - protein, 142 aa, Homo sapiens [sequence omitted]

SEQ ID NO: 786889 - protein, 74 aa, Homo sapiens
NLDGGAQTDHQRESQKDNSMPRSPWVTGTSAHTEVREGTHLVVSGIGLANYFTLGAGRVTDVQIQSTQVLTKAE

SEQ ID NO: 786890 - protein, 40 aa, Homo sapiens
TTAHTCMSVAGRLQKDMSSHFMPQNTTPPSTKLWPMPPSS

SEQ ID NO: 786891 - protein, 34 aa, Homo sapiens
CGMRGRRFGGTEMELGLQPGGRVPLYPQSQPHVN

SEQ ID NO: 786892 - protein, 96 aa, Homo sapiens
RTAERWVFPSYLRGTTYIVTELLDLEIPLSQGHILVNLLEGETCPGYRGIIIRVMCQYLAPSCASGLFRDAVASHSYMKMSHKTKQSSSHEAIVNL

SEQ ID NO: 786893 - protein, 124 aa, Homo sapiens
LPVPSSSHREGLRPGRLQSLRLPLRQAAENQRGIGPGTVSTSFLLLILPSAPPTKLPKISHSHPKSPGPPTSNQRPSGQNPAIVTALSRSVPCPPEHMSTARPFTALRSAPRLQVPAGPAVAAG

SEQ ID NO: 786894 - protein, 86 aa, Homo sapiens
LPSPGNKLKEVMPYALEGKEVMAPPISVPTTPSSFNPKPKAGTEGTQLRRGITWNYKVHYKVTQAQGCSAFSPTLTPRSSTGPCGW

SEQ ID NO: 786895 - protein, 117 aa, Homo sapiens
TPITDSPKKVYFNYREHPGRGSCAAPSLLTGKNSASIKGRSVVSTCFPAHTSQGHPVSWLYWVERCSAASVTSSEWPVSWTKKLSRTTLQGGDIGPELTPPGGKSNSLVLYRCLCRK

SEQ ID NO: 786896 - protein, 150 aa, Homo sapiens
GKTIPVLLREAGAVRLREITAVPPRGAVTVSLKGAFTVPLRGAIASLSEKTSQSSPQREAITVPQREAIAVPLREDIAVPPRGAIALPQREAIAVPLREDIAVPLRGAIVVPLREDITVPLREAIAVPLGGALAVPQRKAITVPLREAIT

SEQ ID NO: 786897 - protein, 127 aa, Homo sapiens
CHPDTIRSITNASGTHAELVVVGARPSFCVVSAVPRSLLEYSCPSLRLPSQCLLPPLPSAPCLGVLGTTGAPRGLNSGPFLEGTPMLKDTGLDRDISSLIGSGMGKRDMGMTTQRTGCLLGQAGMFP

SEQ ID NO: 786898 - protein, 130 aa, Homo sapiens
NGTLKGSNPSCQTSGLLSQWMHSTSSHEGHKQHRSQTLPIIRGKNALSNPKLLQMLDNTMTSNSNEIDIVHHVDTEANIATEVCLTILDLLSLFTQTHQRQLQQCDCQNSLMKRVFDTYMLFFQVNQSAT

SEQ ID NO: 786899 - protein, 147 aa, Homo sapiens
MGTQEDIHFKNQCRGPLLPSPTLIPSGGGGSAEQLLKVQELFCSSSAKQRCHRARLSEKAYSARCTSPSAGAEPPEEEGAGSRSPYPGAGPRRPPSPALQSRDLVSPVYGGTFRTDQKPPRLSADLRRVFSGGPAGLHSSPPWELLA

SEQ ID NO: 786900 - protein, 219 aa, Homo sapiens
RPYLPQEVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEILCLGKQ

SEQ ID NO: 786901 - protein, 95 aa, Homo sapiens
PVGSRNHYSPVRLLLEAWRYFSSSVSEARACSVVLSARGSWDPSLGPGNVLSLLFPPQNTALDKEGQIFCSKHCQDSGRPGMEPISPVPPSVEEI

SEQ ID NO: 786902 - protein, 102 aa, Homo sapiens
TIYAPIHLTAYLSIHLTAYLSIHLPACPCTYLPVCLFIYPVHPSIHPPTYLPACLPTHRKFIYMSVCPSIHSSIHLPTGPFTCLSCHASICLSFNPSSCSVY

SEQ ID NO: 786903 - protein, 111 aa, Homo sapiens
PPISSRQCHFHLPFSQSPGTQDTLTLLSYSNFQFSISPSKSLLGSYLSIPTPRSWLKPFSIHNRRTLTVYVVSIPPISLHPVIIHTNLQQQYHPNHVDHSTTRYGSLLLLG

SEQ ID NO: 786904 - protein, 111 aa, Homo sapiens; identical to SEQ ID NO: 786903

SEQ ID NO: 786905 - protein, 105 aa, Homo sapiens
TGRRMPMALPKGLRIENLFLPLSSSLQRVWLRELSLNPLNTALIIRKQNREGWGVTALMKRQEEARDTGILCCLTLVLRVTVFYNQLWPVACAHTLLLTTTSMTW

SEQ ID NO: 786906 - protein, 73 aa, Homo sapiens
DKDTGSLLGEHGGVISLRSHPHSFPGLGLGPDSEELLNQPCHLWFLCPIFLPGGGNLHGNLHTALRNTPRLQT

SEQ ID NO: 786907 - protein, 90 aa, Homo sapiens
EAADAVAEIESTALQCCDDTVRLRFKKKHVSWMRRLTPVILALWEAKVRWITCGQAGLKLLASSDLPASASQSAGILGVNHRTHRVFFFF

SEQ ID NO: 786908 - protein, 128 aa, Homo sapiens
MHMLAHLLHPMPPLSPAFPLEYISTVAFEAGLLECTPELRIHRVSLYRQAGVVQWQDLGSLQSPPPGFKPFSCLSLPSSWDYSYTPPHPANFCIFSRDGVSPCCPGWSRSPDLMICPPWPPKVLGLQA

SEQ ID NO: 786909 - protein, 74 aa, Homo sapiens
GYKRVLALSVETDYTFPLAEKVKAFLADPSAFVAAAPVAAATTAAPAAAAAPAKVEAKEESEESDEDMGFGLFD

SEQ ID NO: 786910 - protein, 162 aa, Homo sapiens
CPSPFVCPSPFVCPSPFVCPSPFVCPSPFVCPSPFGLAGSFPPAQNMHHHPYHFCFCFLKRQGLALLPRLECNDTIMAQCSLDLLGSSNLPTSASKVVGITGAYHHAQLILFSTVVHQVIQRSHYVAQADLELMDSSESTCLSLPRCWDCRCEPPCLPGRVF

SEQ ID NO: 786911 - protein, 133 aa, Homo sapiens
YECLGTPKGTCLYNNTQYKVCNPESDQPDVCYDPSDPPMITVFEIRLRTGPFLGDTSKVIARTEERGVPKHVTLKFDTCATINSNQQGIRCGSLDWEKSYTAENKYICHESYSCTNVCQYWSCVIWATWKKDE

SEQ ID NO: 786912 - protein, 67 aa, Homo sapiens
MSSPALTILSRHWLSLYLLSLSATGLPCSGVSALLAASRFSPLSLCRPVSFAQSLLVSLLLLPSLHL

SEQ ID NO: 786913 - protein, 111 aa, Homo sapiens
DDPVNPVHWNIIQPYNGGGILTHAPTGMNLDNITLGEISQIPNDKYCKIPLIRGSYSSQIQRQSRMMVVRGWGQQGRMESYCLMGIEFKFEKIKTFWRWMVLMVAQECEYH

SEQ ID NO: 786914 - protein, 33 aa, Homo sapiens
MDILGGGGSIVHATQLARVMCYSFLYERPGYHV

SEQ ID NO: 786915 - protein, 114 aa, Homo sapiens
LGHLDAAADATSSMHFICSASREGDLWGETERLREERWEERAGQGHTVAQFTPRTAHPALPHVGLMPPLETHPVPPHTHTEVSSCLPHTLRPCLQAARSKPPGMQPLFFYVLEQ

SEQ ID NO: 786916 - protein, 233 aa, Homo sapiens
RRAAAFCIRDPLPPLLCCPLLCHVGSSAICSALCFRGCLCGCLPHTGAPANPMRQPLCKAPGQPRGPQRPGGCTPIPPAVGPLVLHARVSHTAAHPLPQGAPAACPAPPGACDRTVPAGGSHVPTCSQRGASVPRHGTAPQKMRALAEQAQTPEGKPLSGGGLTHVTSESVLAETVMGLSLSVQMRTHKELTSCLDIKPRNSQPRAGSLGCGVWSQSRNISQATAQDTAGWGS

SEQ ID NO: 786917 - protein, 47 aa, Homo sapiens
TDTGIEKKTKLYFQSAPKLLWSPLHLDSSSFLILSEHTANLNFSPYS

SEQ ID NO: 786918 - protein, 170 aa, Homo sapiens
DGGPSHFWASATAAAGAQRSEPEIPDLPDQLVPQTKCHLELLQLYGRPPGTKAEEAPASSHCQLTLSSSNTVSEDGPEAVSSGHTQCEKTADTAPGQTLGPRGGSPRSQSSRPRRHKFPLLPRRRGEPLMLPPPLELGYWVTAEDLDREKEAAFQRINSALQVEDKAISD

SEQ ID NO: 786919 - protein, 102 aa, Homo sapiens
QIGTAPVYSSQHERRRRRVISAFPSELPTGRLIETFQSNEHQSEVKLLKQDKKKWVGSWNENIHQQLKAQTSKGIFPHPLPLWNITAFGETTCNRHHSRHRS

SEQ ID NO: 786920 - protein, 115 aa, Homo sapiens
KLLLESCRQRALFQLSMEILGAAPSLRRSLPSFPALGAGPSRPGGSKAQAFRQQQQATGWAQARGPWQEKFLAVPPLHSEASEGGTIQDSFLPGEVPLQLPSVHAMDISSTEVQC

SEQ ID NO: 786921 - protein, 39 aa, Homo sapiens
RERCITKNIGDFSLAGSSFPKRWRCSPEIALRLAGDTGS

SEQ ID NO: 786922 - protein, 118 aa, Homo sapiens
ELSNMTQLKELDISNNAIREIPRNIGELRNLVSLHAYNNQISYLPPSLLSLNDLQQLNLSGNNLTALPSAIYNIFSLKEINFDDNPLLRPPVEICKGKQLYTIARYLQRADERDALFH

SEQ ID NO: 786923 - protein, 111 aa, Homo sapiens [sequence omitted]

SEQ ID NO: 786924 - protein, 69 aa, Homo sapiens
AGGGRKGPVGRPRGRWRRNKTPAGGCRSDGAWGLKTRWEGHPSPTRGTWGLEAIDLPDCCEWDRRAAWR

SEQ ID NO: 786925 - protein, 110 aa, Homo sapiens
ELDTKAPGFDPIRCLVVKGSDSCPGSSLALDVPHLASHGAKGAPALKPPCVSVCSMCTPAGDLGPGMPSAGRTPSITFKCNLCHVEGKNTFLDSFPRLHLLQPVSDFKQP

SEQ ID NO: 786926 - protein, 83 aa, Homo sapiens
EEEKEDEEKEEEEEDEEEEEEKEEEDEEEEEKEDDEEEEKEDDKEEDKEEKEEEKEENSEKLQKLRTPRERGSDAERTASSLL

SEQ ID NO: 786927 - protein, 37 aa, Homo sapiens
MLSDIALLLPVLGVPLQCRRCSHLMQVSSAVALGELE

SEQ ID NO: 786928 - protein, 105 aa, Homo sapiens
KNLLLENGAARWTTFSGTNGMCSLLGSGLTSSCTVVGVRTEGHITSPGSRRRCLRTQLNMHGLVPRQGRPQLARCPRHCRVLVLDWLHTETPGQQNIFFPHPQAL

SEQ ID NO: 786929 - protein, 265 aa, Homo sapiens
KGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGP

SEQ ID NO: 786930 - protein, 103 aa, Homo sapiens
MGKAKGEVGLVGDDRELSLEHANYEICIKYPSEGTHQEVDIRGKGSGKSCGQKNTFRSHQYYQCYKKYESGYSCLLPVSEDRKEKWSLSHTTIRISKECGKTC

SEQ ID NO: 786931 - protein, 38 aa, Homo sapiens
MTSSRKSNWENSALRDGAALRYLDYNLRWDVSEAFVLA

SEQ ID NO: 786932 - protein, 136 aa, Homo sapiens
MNCADCCVETVSPGGLYALQAPGLPLPLSPAESLTTQWNVVQICGINVCITSVHLWNGAVSPSFWARAAKPQNHHALSGFSTEPRMFLCQVLGWDGSCRILLELPNNPTRAASVVPIFQEGSKAQRSGVAYSRPRS

SEQ ID NO: 786933 - protein, 123 aa, Homo sapiens
IALVLSDAFRFFYFLDTESHCVGQARGQRCNHSSLRPSDPPASASQVAGTPSTHHHAQLIFVFLVETGVHHTGRGGLKILTPKGPPAIGLPKRGDYRCEPPCPAFLFIFNKFSSILYILYTLG

SEQ ID NO: 786934 - protein, 87 aa, Homo sapiens
LGDLEDPYCFPNTITSSSSSNIKHCHHPTVSPVHYKTCEQEMMGIRRRALAQPGIQEGLLEEVELSQVSKDECELVKRKAFWVEGTS

SEQ ID NO: 786935 - protein, 52 aa, Homo sapiens
LTDLPLGQKQEAERFSHGGCKIEEFWRPDVWILSVLGVLFSLTIPPLGLIKG

SEQ ID NO: 786936 - protein, 33 aa, Homo sapiens
MGLSRGSREDSMSLPFPASRGHLHPLAHGPFLH

SEQ ID NO: 786937 - protein, 164 aa, Homo sapiens
MQIIRHSEQTLKTALISKNPVLVSQYEKLDAGEQRLMNEAFQPASDLFGPITFILHQIGSPPTLRLPKTLNSSSVILTERHPLQTNAAFIYSPIGSLGNTRIISEEYIKWLKAYCQAYLYGLTVKLLDLVPVSATRCSFRVNNNSQTKPTSSCRRHLEVLKKVS

SEQ ID NO: 786938 - protein, 155 aa, Homo sapiens
TSSVSTLIQTAILIVQYLQRGLSLDRAFSEACWEVYVCSQHSPANRKLVQALLEKHVSSLRAHETWGDSILGMGLWPDSVPSALFATEDSHLSTVRRDGQILVYCLNRMSMKTSSWTRSQPFTLQDLEKIMQSPSPENLKFNAVEVNTYWIDEPD

SEQ ID NO: 786939 - protein, 103 aa, Homo sapiens
QFGKRHKPVGLGDQVTHFRGVPCMKLTCKHLEQLWPGQTRLWMMEFAFAGCVNLCVFQLVGREYRATNRHTHLAGIIFPSQPQPARHLYYYYFFRSPLRWLIR

SEQ ID NO: 786940 - protein, 112 aa, Homo sapiens [sequence omitted]

SEQ ID NO: 786941 - protein, 121 aa, Homo sapiens
MSTLQPVRLSKMHIRLRLCLKLLQEVSTVLRVEYSLVRLAEQAPTDGNSGSSSPQSLLSVPPTLSSSVLSSFFFRLTPSTIAGTQGGTSPPQQDLFISFTSETFLEFVSSYFHCHFPNSSS

SEQ ID NO: 786942 - protein, 34 aa, Homo sapiens
MSPTVRDVHGQVIALSCKHPTGTYTELDGAASST

SEQ ID NO: 786943 - protein, 137 aa, Homo sapiens
MASGEARKASEAGGLLPREGCLQRVGFWGQEGLPGRGTAWPLLAACLQLRLPAFPGAPLCGPQRPVPQGLSPPCHLQGLPPGVVGTGAPMGTSLALSVLSVDSSAKSRQRGEEQAGQLCPTVSPRVPSSLCPEIGLG

SEQ ID NO: 786944 - protein, 86 aa, Homo sapiens
HSILSNQTSKSSDNRETPRNHSLPKCSSHLEITIPKDLKLKEAEKTDGSKMAHQCPVPSPPLTCAYTATIVLGCVPAVVGLLCCGV

SEQ ID NO: 786945 - protein, 89 aa, Homo sapiens
RIRRHQQACLREKKKGLNVIGASDQSPLQSPSNLRDNPFRTTQTRRRDDKELDTAIRENDVKPDHETPATEIVQLKETEPQNVDFSKEV

SEQ ID NO: 786946 - protein, 36 aa, Homo sapiens
MIVGPGLGSVLGERAEFDIRFGGWANWRCWDKGDDS

SEQ ID NO: 786947 - protein, 841 aa, Homo sapiens
GTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLFSLFQVVQQPSGGNEKQVTTISHSSTLTIQKCGQKTMPVNTIIPTSQFPPASILKQITLPGNKILSLQASPTQKNRIKENVTSCFRSTFICVYENVHHRSFFLSCSVISWLDEVHLLVNSSGKAHRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 786948 - protein, 801 aa, Homo sapiens
GTLVTKVAPVSAPPKVSSGPRLPAPQIVAVKAPNTTTIQFPANLQLPPGTVLIKSNSGPLMLVSPQQTVTRAETTSNITSRPAVPANPQTVKICTVPNSSSQLIKKVAVTPVKKLAQIGTTVVTTVPKPSSVQSVAVPTSVVTVTPGKPLNTVTTLKPSSLGASSTPSNEPNLKAENSAAVQINLSPTMLENVKKCKNFLAMLIKLACSGSQSPEMGQNVKKLVEQLLDAKIEAEEFTRKLYVELKSSPQPHLVPFLKKSVVALRQLLPNSQSFIQQCVQQTSSDMVIATCTTTVTTSPVVTTTVSSSQSEKSIIVSGATAPRTVSVQTLNPLAGPVGAKAGVVTLHSVGPTAATGGTTAGTGLLQTSKPLVTSVANTVTTVSLQPEKPVVSGTAVTLSLPAVTFGETSGAAICLPSVKPVVSSAGTTSDKPVIGTPVQIKLAQPGPVLSQPAGIPQAVQVKQLFSLFQVVQQPSGGNEKQVTTISHSSTLTIQKCGQKTMPVNTIIPTSQFPPASILKQITLPGNKILSLQASPTQKNRIKENVTSCFRDEDDINDVTSMAGVNLNEENACILATNSELVGTLIQSCKDEPFLFIGALQKRILDIGKKHDITELNSDAVNLISQATQERLRGLLEKLTAIAQHRMTTYKASENYILCSDTRSQLKFLEKLDQLEKQRKDLEEREMLLKAAKSRSNKEDPEQLRLKQKAKELQQLELAQIQHRDANLTALAAIGPRKKRPLESGIEGLKDNLLASGTSSLTATKQLHRPRITRICLRDLIFCMEQEREMKYSRALYLALLK

SEQ ID NO: 786949 - protein, 72 aa, Homo sapiens
VIRYTMRSAVVQLMARCSLKLLGSGDPPTLACPEYLEIIGECHHAQLIFKFFCRGTGVLPCCPGQCQTSGLK

SEQ ID NO: 786950 - protein, 161 aa, Homo sapiens [sequence omitted]

SEQ ID NO: 786951 - protein, 85 aa, Homo sapiens
GVEQGLAHFFLKADCEYFRSCKLPTGGSLHNHSLPVRPKAAVTTQTGAESRRNDTDGRCVPVKLYHSLPVRPKAAVTTQMGAVFQ

SEQ ID NO: 786952 - protein, 103 aa, Homo sapiens
NGMVIRISTSKSFCILPRDDASKLQERVGCLVHLKSKTSRQIWGNNMTITIIYIKENSLRDDYRFLELGSGEVLFIEMSLRRPGTLAHVCNPSILGGRGRWVT

SEQ ID NO: 786953 - protein, 116 aa, Homo sapiens
TGQHTAPHGTAHTPMEQHTHSHEQHTHSHEQHTHSHGTAHTPTERHTHPRNSTHTPTEQHTHPRNGTHSHGTAHSPTEQHTLPRNSTHTPTEQHTHPRNGTHSHGTADSPTEQHTH

SEQ ID NO: 786954 - protein, 271 aa, Homo sapiens
PSKDIRSRWVTCARRLMPAMFQDPGTALAAPMARRDLWPGRPFGRVDHSGLSALCPPVLRLRTPPLPPSKRAASNLALYGHVRVLGGGRGPGGPYATAPPPTPRLPTWAWLSGCSEGPAASWAVWALRPYWASPYHGQRPGLAFSLICLASPIPTPACPLATRPGRLWRPLSCHVSWLGLKLTGGWPRSAMAVGGRARLFVETPQRPPPSPSSSSAAALGLRISSPGFAWQRPWRHWGAGIKLLSKGRGLCGLGGGGEEVLPDCADFPSVD

SEQ ID NO: 786955 - protein, 126 aa, Homo sapiens
KLLMWDNFAYQYTSIYFICFNSCEISHCMKRLKSVLLLWIFGMMNHWNKTERAIKAFDSLAGQSERFITEDSNAKRGGELSESTCCNESPESHHPKRQETTWPKGQRPPGLPAVPDANLSSHPVCG

SEQ ID NO: 786956 - protein, 72 aa, Homo sapiens
IKCIQCASIVLRLWIPDEEDPVLIFKDHAVLWKRQAHTKLQHKSQARWLMPVIPALWEAKGGRAGGGGGGGG

SEQ ID NO: 786957 - protein, 121 aa, Homo sapiens
MVSLETGSTGQPPCSDCISTAGPAPGPHLGPAWCLTMLSPVFPKTPRSCSRLPQEGLCQLPEKQKSDHNLEIDALTSWSLHPAGAVLPSPCTASVHLLSALILIIFDIHLHVVIIAAQIVK

SEQ ID NO: 786958 - protein, 114 aa, Homo sapiens
FSLSPSFLPSECWEHNVAYEAQGINIVPIRCSLNSTVESILIGCRVIVYKTHCIKADNICESSDFLFGSSVNIIIVSCRYFYSRINRLSSTSIYKDLNMAEEAKMGAFCVPPVK

SEQ ID NO: 786959 - protein, 40 aa, Homo sapiens
TEEAAGMGHHTGNGLRKNSQDAREKFLRVHNQPIVQVQTL

SEQ ID NO: 786960 - protein, 118 aa, Homo sapiens
PDGSRALLRVDLRELSFSDWLISRGTVSSGPSCCSTGRWSFLFMAELFHCGERLHFLDSLIHRHSRCFRILVIVNGAAVNMACKWDFQTLLFYVCFWFLVFLFIFVFVFDGVSLCRPG

SEQ ID NO: 786961 - protein, 93 aa, Homo sapiens
HIVCMCLRMCMSICVPVCMCVCVNAGVYQRMNAPVSTCICVHVLTRVFVCICMHVSVYVRARPPAGSVVRAFRGGVRLSGDLSHSTAVPSHSQ

SEQ ID NO: 786962 - protein, 54 aa, Homo sapiens
LQIQGSSIRGLCPNAMSPQAQVQRKPAKRFPGFLFSFLRSVSGFLSTFRFHVVL

SEQ ID NO: 786963 - protein, 246 aa, Homo sapiens
MSQQRPARKLPSLLLDPTEETVRRRCRDPINVEGLLPLKQYRTYFYERVHCTNYCAPLRTSSSHVTETSLLDCYSAWFTLNSETFTGLLVRSAPGGILDLNKVATKLGVRKRRVYDITNVLDGIDLVEKKSKNHIRWIGSDLSNFGAVPQQKKLQEELADLPAMEDALDELIKDCAQQLFELTDDKENERLAYVTYQDIHSIQAFHEQIVIAVKAPAETRLDVPAPREDSITVHIRSTNGPIDVYL

SEQ ID NO: 786964 - protein, 217 aa, Homo sapiens
MSQQRPARRVTQSPPGPDGGDGSPSVPRPHQRGGPAEALKVKRPRFDVSLVYLTRKFMDLVRSAPGGILDLNKVATKLGVRKRRVYDITNVLDGIDLVEKKSKNHIRWIGSDLSNFGAVPQQKKLQEELADLPAMEDALDELIKDCAQQLFELTDDKENERLAYVTYQDIHSIQAFHEQIVIAVKAPAETRLDVPAPREDSITVHIRSTNGPIDVYL

SEQ ID NO: 786965 - protein, 213 aa, Homo sapiens
RGEQDARPGSMSQQRPARRVTQSPPGPDGGDPINVEGLLPSKIRINLEDNVQYVSMKRSAPGGILDLNKVATKLGVRKRRVYDITNVLDGIDLVEKKSKNHIRWIGSDLSNFGAVPQQKKLQEELADLPAMEDALDELIKDCAQQLFELTDDKENERLAYVTYQDIHSIQAFHEQIVIAVKAPAETRLDVPAPREDSITVHIRSTNGPIDVYL

SEQ ID NO: 786966 - protein, 207 aa, Homo sapiens
MRQRFSIKAHSRLPYLVISDGYMVTTLRFLDSLSPSVHMRSLLLDSTQRLEKIYQSVILSKPKGKGLNLRSLNSLRSSLLEHQGNESSADFTVPKFLQAEETINENAADFQDFEAEETNEGRHFPDNLCPFWNKRDDVLCSSMKEGRLEFASMFDTIHAKDDSEETDRTITELHSIQKSLLAAWTIGISKTVTEKNLMLNYIVVCIT

SEQ ID NO: 786967 - protein, 111 aa, Homo sapiens
SSPELALLHHATVLGRYKNQQFHKTFYSPTLTISSVSLNREETKQKASVLYFLLDVAVTHPLLCETTYVVTRMATPRALTQGKRKSYDEWVLGSRRAPNLCFCRNQCIHKH

SEQ ID NO: 786968 - protein, 35 aa, Homo sapiens
DHQAEVVFNTFLHCEINVEYSYSTFATGKLIFLFV

SEQ ID NO: 786969 - protein, 337 aa, Homo sapiens
PVTKEGRASIVPLAVASGLCGYLSVNSCMGRVRRIYPQLLLALLIQVDYHIGLEPAWLLWLLTKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILGRRSEKTAKVKALLASMVKGLKNMDGMLVVEGGPQGSRAVFKGRDQKLMDSAVYVEMLQILLPHFNDAREVVRFCINLYGKVVQKLRAPRTEAMEQLVSTFGAPTADHAGQLPGKPKVCEPGYGSYFGWELPN

SEQ ID NO: 786970 - protein, 354 aa, Homo sapiens
PVTKEGRASIVPLAVASGLCGYLSVNSCMGRVRRIYPQLLLALLIQVDYHIGLEPAWLLWLLTKDTKKGAQPSPFVPVRWVVKVVKTLLLRMGCSYETTFLEDQGGWELMEQVESHHRGVALLARSPWGWIPEGTTPLPTPRAMVQYSCQELCRILYLLIPLLERGDEKHRITATAFFVELLQMEQVRRIPEEYSLGRMAEGLSHHDPIMKVLSIRGLVILGRRSEKTAKVKALLASMVKGLKNMDGMLVVEGGPQGSRAVFKGRDQKLMDSAVYVEMLQILLPHFNDAREVVRFCINLYGKVVQKLRAPRTYAMEQLVSTFGAPTADHAGQLPGKPKVCEPGYGSYFGWELPN

SEQ ID NO: 786971 - protein, 61 aa, Homo sapiens
RWRPACLSSWGGLPPPLRTLRGISVTPNGYHFQRPPTLKRRLTLAPCLDGGAPEPGVTIPP

SEQ ID NO: 786972 - protein, 246 aa, Homo sapiens
YFSTGFPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLH

SEQ ID NO: 786973 - protein, 103 aa, Homo sapiens [sequence omitted]

SEQ ID NO: 786974 - protein, 108 aa, Homo sapiens
MRQRTFLLSVFQKSNTGHGLFLGRQPSFSVRSMPGTPALAICQPHNPGPPMGTPTEDPSGCSFPCLFLSPQSFLVLSWAISRLPSLFLLSGLCPQKPQTSSPCTQSKG

SEQ ID NO: 786975 - protein, 141 aa, Homo sapiens
MQETSLALRTSDQLREHSGLCLWIWVFNNREETARRQRISELQMLASAIRQTPAALPTCKNFKASKRNIQQPLWDFASSDENLATGPRNACSLGFLLSHAPPVRALTGSLTARLSSPLPELLELKPKAPHRLLPRSPRLGG

SEQ ID NO: 786976 - protein, 105 aa, Homo sapiens [sequence omitted]

SEQ ID NO: 786977 - protein, 150 aa, Homo sapiens
LCTDLVQCLSLTSGTFGGLLRAHPYTSVTPHTSTPAPLPTATPIPVDQLGPGARREVTLPLGPGENGGLDLPVTVSCTLFYSLREVVGGALAPSDSEDPFLDECPSDVLPEQEGVCLPLSRHTVDMLQCLRFPGLAPHTHGPPHTRPHPR

SEQ ID NO: 786978 - protein, 44 aa, Homo sapiens
MGNIAGALESPRFTRLPRPSHSDAIYLPNCSSDAFITLLDWSTV

SEQ ID NO: 786979 - protein, 106 aa, Homo sapiens
EQAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVILH

SEQ ID NO: 786980 - protein, 133 aa, Homo sapiens
RIELRYQIHLSIPPNNIFKFHVVKLICSFVLFMEHSIPWMFTPVQMWVSTIPGRQASPAISEDCSTFPIVTTPTRGSHTPVLHHCSYVFPRRSHNGVLQCVAGSSEICRTPLRLIRMRASAFVFSLFFLFFLE

SEQ ID NO: 786981 - protein, 34 aa, Homo sapiens
AQPVEEGEEEPKLAPGGVREGCLEEAALSLKDKC

SEQ ID NO: 786982 - protein, 121 aa, Homo sapiens
MLPICNQTRNTHHHQQETQCSNFMRKHGFLLHLLRSGYLCIATLGDVFGNNPVIGFRWQILCSPDFYVNSTLHRVSTTPSHTTVLSHLGVYLIEPVSEELCPEAGRPSWQLAHFYKTTLVD

SEQ ID NO: 786983 - protein, 474 aa, Homo sapiens
MTTFKEAVTFKDVAVFFTEEELGLLDPAQRKLYQDVMLENFTNLLSVGHQPFHPFHFLREEKFWMMETATQREGNSGGKTIAEAGPHEDCPCQQIWEQTASDLTQSQDSIINNSHFFEQGDVPSQVEAGLSIIHTGQKPSQNGKCKQSFSDVAIFDPPQQFHSGEKSHTCNECGKSFCYISALRIHQRVHLREKLSKCDMRGKEFSQSSCLQTRERVHTGEKPFKCEQCGKGFRCRAILQVHCKLHTGEKPYICEKCGRAFIHDFQLQKHQIIHTGEKPFKCEICGKSFCLRSSLNRHCMVHTAEKLYKSEECGKGFTDSLDLHKHQIIHTGQKPYNCKECGKSFRWSSYLLIHQRIHSGEKPYRCEECGKGYISKSGLNLHQRVHTGERPYNCKECGKSFSRASSILNHKKLHCRKKPFKCEDCGKRLVHRSFCKDQQGDHNGENSSKCEDCGKRYKRRLNLDIILSLFLNDM

SEQ ID NO: 786984 - protein, 104 aa, Homo sapiens
MIDDPSKGKEALAESGGLVGAGNGVFFPSTEAFWDGGAVLASRGLELAGSSVPCCERFQDFDLAQPASLHPTCATAFSQCDVECYSMSLYFPLLFLVMGTLEPS

SEQ ID NO: 786985 - protein, 100 aa, Homo sapiens
GSLLHLRAALPFTFVQTGAAHLCAGGGFFFQSTTPGGISFPFQGLARAKYSDDTKYTAGLPAADLIPTTLKTRKVWVIYSGEQPLYVNDVLKFDQSQLLG

SEQ ID NO: 786986 - protein, 110 aa, Homo sapiens
WDTGLGTEIQFCSRLTGGLGQATCLFICAAKETVSTSPVTLQRLHSHSLTSEAAYQKTEGSAKTREREPWWRKPRKPQTAGGGQGPRDSQGTDVHSVGKPQVSVISTPGQ

SEQ ID NO: 786987 - protein, 119 aa, Homo sapiens
RPSTQSGRTGLGGGQAQAQPVGKGEACGAQRRGQGSELPRHLPFCAIPRVGGGNLGPLLLPTTGIPVAPEPRHSVPRTGSTALFNLQTALGQEVDTVVNFSEEKWKPIHPPELPPGVRT

SEQ ID NO: 786988 - protein, 130 aa, Homo sapiens
PSSSTALQCPGSRQSPPGVLRFHNQLWHVLTGRAFTNTYLFYGAYRVGPESSSVYSIRLAYLLSPLACLLLCFCGTLRRMVKGLPQKTLLGQGYQAPLSAKVFSSWDFCIRVQEAATIKKHEISNEFKVC

SEQ ID NO: 786989 - protein, 70 aa, Homo sapiens
SLSHVSCPCSISLYSCPPTPLHPCTCLSTALSLSVSHSVFLYISCTRVHTDGQGPAHFWLLSHNPTSTHH

SEQ ID NO: 786990 - protein, 209 aa, Homo sapiens [sequence omitted]

SEQ ID NO: 786991 - protein, 209 aa, Homo sapiens [sequence omitted]

SEQ ID NO: 786992 - protein, 31 aa, Homo sapiens
MGWLSLTLEVAQHLIVVQDSGTLNINLVKAD

SEQ ID NO: 786993 - protein, 53 aa, Homo sapiens
MQAKLEEQLLPDLSSWALAPSSCLVADWPYSHSILVHSDSATNFHSMVHSFHS

SEQ ID NO: 786994 - protein, 106 aa, Homo sapiens
MLSRHSAKWETSSGFCSMGSRSLQSPMSLEDHKVARALGELCCGIVKLPSGAGRPRGKAWSSLPLHLVLSPGPAVCHPAVCQHRCGTGRGRILPVMVECHCQGSKK

SEQ ID NO: 786995 - protein, 84 aa, Homo sapiens
TCTGGQSCKDKGRRQPSPSQGERPQEKPTPPTPSSWTSSFQNWGNEFLLLKPQSAILSYSSPCEPAHPSSPSLSLTPLSTVGHK

SEQ ID NO: 786996 - protein, 39 aa, Homo sapiens
TEIMSRNSIKAPGQVCEGGVIDTQDLEINCVGLAEAMPT

SEQ ID NO: 786997 - protein, 114 aa, Homo sapiens
THLSRPQGSDESCFLLLPCFLPKRIRGSLQKFIKYNRIKIDQRENNTGTHGTMNQEGRTQKCSLAGAPQSSKVDCKQDSELRISQNKEGNLPVLRLTKSTRLKPTLAGCSGSCL

SEQ ID NO: 786998 - protein, 101 aa, Homo sapiens
PFPLAASGHTDSLHLLIDSGERADITDVMDAYGQTPLMLAIMNGHVDCVHLLLEKGSTADAADLRGRTALHRGAVTGCEDCLAALLDHDAFVLCRDFKGRT

SEQ ID NO: 786999 - protein, 267 aa, Homo sapiens
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSIWATDLGNEILIAPVDEMGIIRLFYFYKEGLYLVKAINEVDDTSKQTTCIKMEISQGGDFAAFLLQGAGDIWLDVYKLPKETWLKKLEHPQLFASSSPLASAFQSAGIIVVSHCALPSLF

SEQ ID NO: 787000 - protein, 155 aa, Homo sapiens
MSFPRGSQTQKIKHPIGTRKGPLEVPPPTEKDWPKDDEQDHVLVDPDEELDSLPQPYRMINKLVNLLFDQSWEIIEERNALREAESSQIQPTVYPPLGEIQLNKMPNCMAVSQDYVFIGGAKGFSIYNLYSAKQIYAWEKLKVDVTSMLGHRFRE

SEQ ID NO: 787001 - protein, 133 aa, Homo sapiens
ELPPFVGFEKPRAPEVVDKGYGLLPMKDEVYDMNEAGQRCWQLIFYGQQHQQRREVASVPTAGLLSLWSLWMTAMPLPPAPWPTCIHLQLQTAPSTLMAISGPKALSSVTTGAQPGSFYFLHRSPSTTGGKEP

SEQ ID NO: 787002 - protein, 58 aa, Homo sapiens
IPGYLSCFFPTAQQECPPFPDQVMPPSLETPVYSLSEAVSPLDCFKANTAVLAAPSGA

SEQ ID NO: 787003 - protein, 423 aa, Homo sapiens
RRSWRGGTTERATMGDRRPQDRPRSQGMDSKPWYCDKPPSKYFAKRKHRRLRFPPVDTQNWVFVTEGMDDFRYACQSPEDTLVCRRDEFLLPKISLRGPQADRKSRKKKLLKKAALFSELSPVQPARKAFVEEVEAQLMTKHPLAMYPNLGKDMPPDLLLQVLKQLDPERKLEDAWARCEAREKTTEVPTESGKYPCGESCPRPPETPVSRLRPQLPKTPVSSRRPEPPKTRVSSLRPEPPKTRVSSLHPEPPETRASHLRVDPPETGVSHLCPEPPKTLVSSVHPEPPDTGASHLCPEPPETRVSHLHPEPPETGVSHLRPEPSKTQVSSLCPDLPRLECPISAWTSQHSSGVQFPTQVLKLDSEKKLEDARARCEGQEMTTEELTKPGKYHFWESCPRPFESRMPHLRLVLPITRRMASLC

SEQ ID NO: 787004 - protein, 105 aa, Homo sapiens
WRQLKCPLTVGWVSKQRCADIVEYYAAMRMNWQFCKQSTAESHKYNVKQTKQDAEEYILHASMYIMFKIRQNQPLMLGVRIMLISGVNRRQYQWGFQGLEKIVSG

SEQ ID NO: 787005 - protein, 69 aa, Homo sapiens
ACIGPRTDTLLRVSLSCLGTNSESGQGHRRPSPLDGNPGCFLHLNMKSSSRRPVVCLLVTKKPTVSYDP

SEQ ID NO: 787006 - protein, 93 aa, Homo sapiens
SSLGQPRKGLPQCSGGLKGSSSAAKVGALAEEVPRASGALRTASTLSPLNSMGLPVAVVSAKAKTFLSYTGRKQQCWDLNPGMSRSRICALNQ

SEQ ID NO: 787007 - protein, 120 aa, Homo sapiens
VTHMHTQCTCSQTHTHMLTHMLVQCTHTPDCTHTHPLAHSHPHLPSHTVTFSHTHTMHQLTLTHMLTHSFTNMPPHTGTHTTHPLTCLHPPTCSNPHCICLHIHNPLTHTWSHPLMLTPH

SEQ ID NO: 787008 - protein, 283 aa, Homo sapiens
LPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHG

SEQ ID NO: 787009 - protein, 270 aa, Homo sapiens
MLSDDHVNEIIIQVENVSSGVQSHPSSNQIFQEKVLLDSSINMVLSISDIDVIDSQTVSKRNDQKGNQVLRFSTSLNESMSQTLHSLECMGIDTPGSSHETVQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHG

SEQ ID NO: 787010 - protein, 157 aa, Homo sapiens
MTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHG

SEQ ID NO: 787011 - protein, 75 aa, Homo sapiens
CIKILDLHVNLKTTEIPEKNIQENLCELGLGKDSLDTTKAIKAKKSSPSPSHSHHGPRSPSSSLSTVSLYAQNRS

SEQ ID NO: 787012 - protein, 71 aa, Homo sapiens
ELLTKAFPLEENHIKCNSPDFNSLTMLSLWLEAVLGCHDLSMKVEQLEAVCQLCFSQWIPLKRIRAPSLHS

SEQ ID NO: 787013 - protein, 68 aa, Homo sapiens
LKGVSPGSPAGGERHTISNLAMQNVDLLYGMETFEKLNLLSNFPTEMATKCPPFLYALTSRRNLKVFH

SEQ ID NO: 787014 - protein, 71 aa, Homo sapiens
KVKGQHRPELTALDWKLWQLGSVLGDFVDPTVPPTEYLQRTGTCVTEGPGSTDLNNHDTLCIGLPGPNPRD

SEQ ID NO: 787015 - protein, 206 aa, Homo sapiens
MSLPESPHSPATLDYALEDPHQGQRSREKSKATEVMADMFDGRLEPIVFPPPRLPEEGVAPQDPADGGHTFHILVDAGRSHGAIKAGQEVTPPPAEGLEAASASLTTDGSLKNGFPGEETHGLGGEKALETCGAGRSESEVIAEGKAEDVKPEECAMFSAPVDEKPGGEEMDVAEENRAIDEVNREAGPGPGPGPLNVGLHLNPLE

SEQ ID NO: 787016 - protein, 66 aa, Homo sapiens
NEHVLVVPQVGVSCHVDQESRGPASLRRPSLRTGPTPTTKTEMPLFLSFWAGTAASSAPLPPVSTT

SEQ ID NO: 787017 - protein, 62 aa, Homo sapiens
IGLEFSPLHQQTTPGVQPFPTDIPGKGRDGLQVIKYLHHILLAIAHQLLTAPGPGSQVKHLA

SEQ ID NO: 787018 - protein, 112 aa, Homo sapiens
MLCPLLSRAGMASSRKKYSSTSTCPRGVGKRRVAQRGAHSCWWEVFGAQAPKSTSGARNPCWCHEPLTVGRGWGGVLTRHDLLGGGWLFILEMHRALLCPPGWSTVAPSWIT

SEQ ID NO: 787019 - protein, 71 aa, Homo sapiens
QRVLWDLHFSCKIHIQPESSSIAIILILALSWTVHSGRGLSHRIPQHAQHSEQQTRELGEAHLYPETSIGL

SEQ ID NO: 787020 - protein, 190 aa, Homo sapiens
ASLEGSTCCWLSRWRMPPTASSAPSAARPSAPAPRQVRSSSLEGVEVPCGVGEGSLRQEVRTQEPPKDGGQARETETGSLHPGCSASPCALPCGFPSWEPRACLHGGRGAQGLRPKCSRFPVPCSRDRAKSPPPALDHTEEHKEALCLVRDPCILVVLVRVHPGATLMTLCGMYMCAHYAKAVWGGAQQR

SEQ ID NO: 787021 - protein, 105 aa, Homo sapiens
SGGGEMVKERWAQKRVGPRWRCHWLLADPHAGSSPPNPMGMLLCSADIWVLPQGPDRVGIWVDLSQVVLLGLSKLLVLILGSQLWQHLQVRVLLGEAAWAVQKVT

SEQ ID NO: 787022 - protein, 120 aa, Homo sapiens
VSNVKDAPKTAVAIRSYRRRRPQHGALFHHDTQSLLFQRQPSEHLFSNTWQGQRKTIVYSFSNRFLINLLCDGSSYMDPLGLISSAVSTQQDLLAGPDHKADTLQLLRAGGNSQMCKWRR

SEQ ID NO: 787023 - protein, 138 aa, Homo sapiens
SSSGQQQCGTPSQKYNKRKENRLYWLTVLHGIQKCSTRIFSWCGLRKLTIMVKAKAKKVNHTARVGATERSGGGPRLLNNQISCELIEQELTYHQGDGAKPFMRDPPHDPVTSRQAPPPTLGVPFQHEIWRGQTSKPY

SEQ ID NO: 787024 - protein, 169 aa, Homo sapiens
SSSGQQQCGTPSQKYNKRKENRLYWLTVLHGIQKCSTRIFSWCGLRKLTIMVKAKAKKVNHTARVGATERSGGGPRLLNNQISCELIEQELTYHQGDGAKPFMRDPPHDPVTSRQAPPPTLGVPFQHVMFAATHIRRISRVIDLEYRTPGRDYCLARLWPMLAGPYNNY

SEQ ID NO: 787025 - protein, 82 aa, Homo sapiens
HNSTTQAHNSTTQAHNSTTQAHNSAAQLPTAPHSSQQHHAAPNSTTQAHNSAAQSQRRHTSSQRHHAAHNGTTEAHNSQLRA

SEQ ID NO: 787026 - protein, 104 aa, Homo sapiens
SFCNMEYASYSGRAEHMRWQSFPRGACGFRGSTGTRWTEARDRFLVRRSSEKAAGYVQADLLPRRGFLEQVWGIACPPQGSKVKEYGCNKLFYSCIPSMLWATR

SEQ ID NO: 787027 - protein, 115 aa, Homo sapiens
CTYAHMHICQCIHVYAHMYIHMCMGTNACIYMNTCIHTHKHMHKCTHAFTHVHTCACMYIHLYPHAHIYIHICRDGHTYIHMHTNTQNMHAPHSTHIHIPNTYHIHLHTPHTYIH

SEQ ID NO: 787028 - protein, 140 aa, Homo sapiens
YAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQRLVQPI

SEQ ID NO: 787029 - protein, 116 aa, Homo sapiens
DTRPPGAEEFHPPAGALAPDSKAVRTACASQQGSPATVASLESLEEVLTGGPPGHREPEPGLLPQKGQRGRCSCLQVRWQGPPPFPAGQPPPVPPGPVSLLRPEVAWSGEQPCTQA

SEQ ID NO: 787030 - protein, 95 aa, Homo sapiens
DDESRGSLQHRREVAPMCPGRFRIATGGCGRAQFGPDDFGRSSFTSDCRTLNSEDSCCAINPASLFPPPSFLRESPYSPRHLSGKCNHVTPSNVG

SEQ ID NO: 787031 - protein, 33 aa, Homo sapiens
MQQGGLRGEELRPPANNHMYLAATAAIAKCHSL

SEQ ID NO: 787032 - protein, 32 aa, Homo sapiens
HRKQKLTELKGEIDNLTIVDGDFNTTTFNNGY

SEQ ID NO: 787033 - protein, 93 aa, Homo sapiens
VEKASVPLPPDKSTSFPTMVLNHSKMTAMTDTELRIWMSTKCIEIQEKIETQSKESSKMIQELKDEIVILRKNQTEFLELLSLLQEFHNTIQV

SEQ ID NO: 787034 - protein, 327 aa, Homo sapiens
LRGRGACYKHTFYGIESHRCMETTPSLACANKCVFCWWHHNNPVGTEWWWKMDQPEMILKEAIENHQNMIKQFERNLEPVTQLYVSVDASTKDSLKKIDRPLFKDFWQQFLDSLKALAVKMESHSVAQAGVQRPNLSSLQPLPPEFKVILLPEPPEELGLQQQRTVYRLTLVKAWNVDELQAYAQLVSLGNPDFIEVKGVTYCRESSASSLTMAHVPWHEEVVQFVRELVDLIPEYEIACEHEHSNCLLIAHRKFKIGGEWWTWIDYNRFQELIQEYEDSGGSKTFSAKDYMARTPHWALFGANERSFDPKDTRHQRKNKSKAISGC

SEQ ID NO: 787035 - protein, 286 aa, Homo sapiens
LRGRGACYKHTFYGIESHRCMETTPSLACANKCVFCWWHHNNPVGTEWWWKMDQPEMILKEAIENHQNMIKQFERNLEPVTQLYVSVDASTKDSLKKIDRPLFKDFWQQFLDSLKALAVKQQRTVYRLTLVKAWNVDELQAYAQLVSLGNPDFIEVKGVTYCRESSASSLTMAHVPWHEEVVQFVRELVDLIPEYEIACEHEHSNCLLIAHRKFKIGGEWWTWIDYNRFQELIQEYEDSGGSKTFSAKDYMARTPHWALFGANERSFDPKDTRHQRKNKSKAISGC

SEQ ID NO: 787036 - protein, 67 aa, Homo sapiens
QMAPGTIKCNRVGMDGVHAGSQKSRQVLIRTWNDAATVRTDVGHHLIGPSDQIPTLSIPPQLPPRLP

SEQ ID NO: 787037 - protein, 111 aa, Homo sapiens
CRIKLSPLNMFTHCHLLGKRDRRSSAFRKSGCKGPEGRESGLVIVVGIGKSRTDVLVISLWGRADVRCVEGTAVLLGRSSVQRLGDLGPGVAQHSVGLLESCCWHLPTLGS

SEQ ID NO: 787038 - protein, 49 aa, Homo sapiens
FCRKQRTCPRDRAAAPPQGSTFGRAKFCFHIGMPVGPLPPGHATKATLA

SEQ ID NO: 787039 - protein, 39 aa, Homo sapiens
MGSGETKPNYSTAPLGAYHMILLKEFTGHTDRLATSVLI

SEQ ID NO: 787040 - protein, 74 aa, Homo sapiens
AEILPLHSSLRDERNSIPFPQQKKKRKAYICLTGNIRPRPGAGDSERIKQIFHVMEDRLAKLVTSWVTRVKLHL

SEQ ID NO: 787041 - protein, 68 aa, Homo sapiens
CRWQPTGDREPTQNPDLTRNGAPGTWWAGLAVTGAGGEGHSHPKARPGFQSFLRDLFMVPEGSFLVLR

SEQ ID NO: 787042 - protein, 118 aa, Homo sapiens
QKQHAERMSRDGGSTMTLSVPASPQPSHHTGEGGGPSDPAGLCTLGVPRLTLFLQSSEAGTGPRWGKGRKTSACPAPWALPWMLYTTGQRSRLSFEKHLETGSHPVTQTGLKLMASKD

SEQ ID NO: 787043 - protein, 150 aa, Homo sapiens [sequence omitted]

SEQ ID NO: 787044 - protein, 114 aa, Homo sapiens
AAGQRGSSLLRWGGCRAEGLLTSQTGRLPGRGSPHFSDRAAGQGRSSPPRRGLGRAEALLTSQTGRRGRGAPHISDDGRPGRDAPHFLDVMAAGKRCSSLPRCDGGREEVLLTS

SEQ ID NO: 787045 - protein, 101 aa, Homo sapiens
GKSGGYKKSDGVKDPQRATNTTIEDEDTKVRKQEIIKVTEQLIGAISNGDFESYTKMCDPGMTAFEPEALGNLVEGLDLSIVGNENFGKQMIHPKAHNRLQ

SEQ ID NO: 787046 - protein, 35 aa, Homo sapiens
MLSTFYQAQDSSSHSKEVPGSERQQGQRGVCPGTE

SEQ ID NO: 787047 - protein, 145 aa, Homo sapiens
PRDAACRELHRCGWALSSRQPGTPKSSSPGGCVPGGLKHGLQRETGAQRRARTQHRRHSDGDEQGSLGNETLLPLTLLPRNRLTTSNLGLRWAFWGWGVSSGVTATEELCPLSAGEALDSQGLVSSCQRLGGSTRWGSHHVKEGR

SEQ ID NO: 787048 - protein, 87 aa, Homo sapiens
LADPHFKSIPSLKITHTAKSPLKFWVGGAHESSGASQWNLRCRVKGSTCRVTQTRKAQIGELGCRTYPAQNPNYRTQKVQCAALLNS

SEQ ID NO: 787049 - protein, 292 aa, Homo sapiens
MKLLVQCSGQRTLRSLGLRPKLPWTAVEHGLNLTWKTAQQHDAWHIPSSSAIMTVTHAQLVPQGSPLLKTLPHQLGSFGVKDEVPTAATAPSCAHCSLALSISRHTDLLAVSGHTGTFALPVRLSRTSCPETGDWWSFLTQRINPQKSPTMWILPTPLIFLIQAFLMLTKHSPKPKEKSNVQTHNPSTNLHMICLFKCATHLHTTVQEVKASGGRDRSLVPGAPWNQAASWEQLHCTTPACSIDTPVSAAQNTVEASTVFCSGVSQLLVVSEVYMIADIIDCFTIPLWFRTD

SEQ ID NO: 787050 - protein, 129 aa, Homo sapiens
MVVVVVGRRLMSTKLPEGASSRLHLTLRRSRSRCLLNKRSVVNHVIEHHGMALIPGRIKVSSPGMARFPKAELDLRGARLCHFASCRKTHAIQKIISSGVMEKWWWVQPFLPEDSVVSRSLGDGFDTEG

SEQ ID NO: 787051 - protein, 136 aa, Homo sapiens
KHPYNSFKDSTGSSGFLGECKAGTEPGENSVAPLVLRATPRPALVAARWFGALAVSTEGLPGSGRCCCWRQAFPAGHLDLIGIPGATGERCLPVLSGAPAGNSRTSGLLITTVQGSELELALSSSQEPSIKCLGIL

SEQ ID NO: 787052 - protein, 76 aa, Homo sapiens
LWNPSGWKTPSNYKSLGYFLLPFKSSDACSSMPICFCLRGFIQIKLEEKSRSPNYNYLSKNPLNYLGNPDKFGVQR

SEQ ID NO: 787053 - protein, 90 aa, Homo sapiens
VSQESLPLQEASACKQWAVVWVVVPSPMVNLLDADLLIVSSYEIWLYNRMWHLLSLSVLLLLLPYEISHCRLAFWYGYEGPDQCGPHQWT

SEQ ID NO: 787054 - protein, 78 aa, Homo sapiens
PLQSVDFPAAHCPPKSGTRAREMEDFRGIAEESFPSFLTNSPLFGNSGILENVTLSSNLGLPVAVSTLARDRSSTDNR

SEQ ID NO: 787055 - protein, 116 aa, Homo sapiens
VPYYDTCATSNTWAQTILPPWPLEQLSSQLIFRSHHVQLIFVFLVETGFHHVVQAGLELLTSGDPPASASQSAGITGVSRCEQLHSAGWLVSLNIMTSSSIHVVADNRISFFFMDK

SEQ ID NO: 787056 - protein, 136 aa, Homo sapiens
PIHTVHLTPQAESCSLPTSLHPLWPQRVASCLSDIIDQLQPGQTNFSAIQWAATVFFQRGLNPSLKTGSLFQVCHSLGTLPWPQAIIKFSYISYSFSFFFFFLTVLLYRPATVQWCDWLTVAMTSQGSGDSPTSAS

SEQ ID NO: 787057 - protein, 69 aa, Homo sapiens
SAKERRRAKETGSLALGTHNPAMNREPQAGQLAVGIPMKNGLSRQSRQGFLTECMSGKENLVIVLRFLT

SEQ ID NO: 787058 - protein, 76 aa, Homo sapiens
SASHSGVSTAAFSIMLKGIQGCGELLQFIYLQVTSLPSMSHFFEGNLGFSQHKAPSFSSTETCLYLCLFQHSKKST

SEQ ID NO: 787059 - protein, 106 aa, Homo sapiens
SHVPHPPERTTVTQYSTCALLTALCLLLPVLQETAQSRRMVTSHPEDSPALARKHGASQPAGLGFPRTQTVTPAFTFQTPTAAEPALLSAWLGRAPETETITDMAG

SEQ ID NO: 787060 - protein, 118 aa, Homo sapiens
ILFIRSTVGGHLGFPIFFFTIMNICVQVFVWTNVFIFLITHLRVELVSHKITVFSFLRKCQIIFPSGCTILHSHQQWMRLPVSPHFCACEVAVSSWCLPFLKDSKVCRYRHSLAIFLR

SEQ ID NO: 787061 - protein, 66 aa, Homo sapiens
MVVLAAHTWAPGGCWRLRLQLCRENRQGAGGAWSRRLTEAGSRLPPLPPLQCWGRAGGPIRRNCAA

SEQ ID NO: 787062 - protein, 72 aa, Homo sapiens
VRAPVEMGEKAEAPPLSGLFRASSSASLDMRSLRGSHSLWPGHELLNGCQLRVCMSALFWAEPGVHTQSPLL

SEQ ID NO: 787063 - protein, 45 aa, Homo sapiens
MIHVAPGESMILMTRGEKQAGASEELALHTQVLTAVNPGFEHQGV

SEQ ID NO: 787064 - protein, 204 aa, Homo sapiens
SIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 787065 - protein, 73 aa, Homo sapiens
ASLLRDNRDLVIVATTNKETKSSNTSGMKVWLTPSRLPRPAEVLAKNDENLVSISSMIESFVEVWLATILKIP

SEQ ID NO: 787066 - protein, 49 aa, Homo sapiens
MRRRTRRIGTPSSGVLASEHAIYMLRRDLRKQAKEQSRSGHRVGGWLSA

SEQ ID NO: 787067 - protein, 117 aa, Homo sapiens [sequence omitted]

SEQ ID NO: 787068 - protein, 118 aa, Homo sapiens
MSYSCRKPLSPRGLGMKGDEGPQQRGSHLWAVPEKPTDHQGQAASAGEAAKPREGEGDGDREEGQEPALPSAHPPGSHQHFPVRSLLTRDPGQCHFPRPALSTPPEKQQRHSGSGEWV

SEQ ID NO: 787069 - protein, 104 aa, Homo sapiens
VSSSGETFFAPPRPALERGGGGHGNISPAISRADAQHPGARRASAQPGVHLRVPRGLSSPLLLSHTRTLSFTHTHTRIHTLSHTHRTLGASTLLAAVVRWCNSS

SEQ ID NO: 787070 - protein, 103 aa, Homo sapiens
VSSSGETFFAPPRPALERGGGGHGNISPAISRADAQHPGARRASAQPGVHLRVPRGLSSPLLLSHTRTLSFTHTHTRIHTLSHTQPTRPQPTRNPRAHNPRAH

SEQ ID NO: 787071 - protein, 103 aa, Homo sapiens
QPVPWRPGQWGLIYGARQWGHDQWNLVSEALVSKNLVSEALVSKVLVSGVLDTVGLAARAWLVGPGHGVLISESVVREDLISSILSSRMGWTVGQPVCTFCGK

SEQ ID NO: 787072 - protein, 76 aa, Homo sapiens
GGGYWGQQQKESYGRCQILQGWGLAERAFPGQTIPEAPSVANPALQGPLVQQVGQTQKNTTRLSAATISHGHKTCL

SEQ ID NO: 787073 - protein, 89 aa, Homo sapiens
ILKVNAASSTQAAWKGRGTRVGFPCDGQETGGPPTALPGKADVSPKGTGGSWSAVRRRAHPGPGFALIAAVSRQLLGELADDPAPQQEL

SEQ ID NO: 787074 - protein, 32 aa, Homo sapiens
MLVHSPLANCLSALHCQLPLAWAIALTSPLLF

SEQ ID NO: 787075 - protein, 113 aa, Homo sapiens
IDLEDPEMLPYQGSGRGGTPSSASVTGAVDGPGAPWKPLWAQEDCAPPQGLWDSQGPRPQVLFPGSLARVCPDKDFRPRPEYPFLSLTGLTPLATLPGPLVLGHLPRPSQASS

SEQ ID NO: 787076 - protein, 102 aa, Homo sapiens
RTWRWRVALRVARSMCAGAPFTRPCHPPRPARRGPGRWGVGAVRTLRAGPPLLSVRKFTEKHEWMATENDIGTLGVSSFAQETLGDIVYCSLPEVGTKEQTR

SEQ ID NO: 787077 - protein, 152 aa, Homo sapiens
MCTPGWVMTAPALGYNFALKWVPGAGRGQGVRVGTSKPAGTGGASWTPESAGMPGSRAVAGWPQLHLGAWGSCPADLVGGRAPAHSWPVLAPWSAAALATPPPLQLVSPQWLLQMGHHVLTNSNMYIEMQKFYNGESNLEQSWWKRRAWGSS

SEQ ID NO: 787078 - protein, 123 aa, Homo sapiens
MYRFSFLLLPPHPVVLLVFCARTGAGSPALNRALQPSCQLQSTSGLQLVFFPASAHTRMEYYPLIMACLSSSSPSAPGQRLSSRHHSAPACSFAVPTVLSACLTLSVGGHCPSRECGNQLHFI

SEQ ID NO: 787079 - protein, 63 aa, Homo sapiens
MGYEKGKRKTKERERFETVVVVSNVKLLQKFSKSEIGFSSCKSSSFNWCSRSPLDCSVMRNYW

SEQ ID NO: 787080 - protein, 175 aa, Homo sapiens
GRSYENLLGREVREPRGVSPEGRRPPVVVNLSTSPRRYAALSLSETSLTEKGRAGEGLGRNWYVTPEITITDNDLRATERPSARAWELPGGRTRPPPHAAPDGPTSGRQRSLEQLDELITDLVIDSRPTAGQASEPAADCLGPQLRRLLDSRPAGSGAPALAPPRSPPASAGSAE

SEQ ID NO: 787081 - protein, 55 aa, Homo sapiens
LASPLPFFEVSHLWLSGKGMFSSFFLGFQEPLKSFAIPPRFALADSCHGRHKCVS

SEQ ID NO: 787082 - protein, 236 aa, Homo sapiens
MHGILGACGRLRLEPATPLTPLLCAERDECRAHPCRNGGSCRNLPGAYVCRCPAGFVGVHCETEVDACDSSPCQHGGRCESGGGAYLCVCPESFFGYHCETVSDPCFSSPCGGRGYCLASNGSHSCTCKVGYTGEDCAKELFPPTALKMERVEESGVSISWNPPNGPAARQMLDGYAVTYVSSDGSYRRTDFVDRTRSSHQLQALAAGRAYNISVFSVKRNSNNKNDISRPAVLLA

SEQ ID NO: 787083 - protein, 70 aa, Homo sapiens
TWYRVGVCAQGQDSISHVRAAQHKVSQPKGVKTVSIIGIVLGVKSRMLGSKQGEKEVPMVKQAGRLSTEY

SEQ ID NO: 787084 - protein, 34 aa, Homo sapiens
SSHNALCACPQVLVQFLVVTSFSQKKRSRNLKMK

SEQ ID NO: 787085 - protein, 105 aa, Homo sapiens
TATSASWFKRFSCLSLLSSWNYRHAPPCPANFAFLVETGFHHVGQAGLELPTSGRLPASASQSAGITGVSHHTWLISLFLCIPLQLILVMISYGRLEVALIFALC

SEQ ID NO: 787086 - protein, 46 aa, Homo sapiens
APTQSSPEVYPSREKGLTEKGKNNFTSNLMRLKKFLSPLIQFLFHK

SEQ ID NO: 787087 - protein, 78 aa, Homo sapiens
QAPPAPAKSIPVKKETKAPAAEKLEPKAEQAPTVKRTETEKKPPPIKDSKSLTAEPQKAVLPTKLEKSPKPESTCPLC

SEQ ID NO: 787088 - protein, 178 aa, Homo sapiens
LSKGSLFAFAFCLWNHSTSVADARTREEAEACSPPRVWERLGLDWGPLPSGLLMGERQSSLGSCTAEGMPRPETARAASTLCATLLVLRCDCYIKHHIKKITKAVPGLSPRILLPANSARPLYLQWSDTEIAFTPNFHRLILLSRFKPAESRGPGSVLGSGSPGPDPGRRFRGPPGRP

SEQ ID NO: 787089 - protein, 226 aa, Homo sapiens
PQVADQPQVGDQPQVGECKATSQAQAEGHNFPLLLGDPRAGGQVMGLLVSSSQPRMAHSLSACTGTQKASCGHCFPLFLRPLASFLIFKENSPLLIGDQLRRSLAAQRAQQSMRVLGTPFPGRRLPPGKFSNCLAASEGPVVGPPNAIAEEEGKGSRFTNSQTHVTTQTKQQTRWPLQSFRQLGRLAPAVLGFWGPCPALSLPTPGLRTTKEVRKGISNFQVAQEK

SEQ ID NO: 787090 - protein, 226 aa, Homo sapiens; identical to SEQ ID NO: 787089

SEQ ID NO: 787091 - protein, 77 aa, Homo sapiens
PFSHLPLILIVSSFPHPSVVNSHILLPLQPCQTQPWVTPTVHLLSPYAQAAHGQNCTPTLGLLHSVGPTQGLWLFLS

SEQ ID NO: 787092 - protein, 96 aa, Homo sapiens
RSSGRHADCCAHWGWAHQEVGSAETRALTTGARFGFLRPLPAGPRPYRAWWVLPHLLLSPQRGCSFAQGLWGGPGHPEREVAGPSTHAGGPDVLGV

SEQ ID NO: 787093 - protein, 221 aa, Homo sapiens [sequence omitted]

SEQ ID NO: 787094 - protein, 109 aa, Homo sapiens
LCNKNLLKAARGSAHHQTWCIDAGAGLVGASCSCTEAPLPQFCIGVEMCTAAPAVARKQLCRGRMWWAQAQGTGAASQPSLHLPCSSRAPGTWSGWCQMTRTSWTPRTP

SEQ ID NO: 787095 - protein, 44 aa, Homo sapiens
EKEGERLVSCALRVENVISRDGGALSAERGPDRDPLPLTHPRRP

SEQ ID NO: 787096 - protein, 119 aa, Homo sapiens
MEGGRRKEERNEGRKEGKERERKKEKKERERKKKRLNITNHQRNANQNHNDISPQSELLLSKRQGIAGCWQGYGGRGTLIHCWWQCKLVQSLQRTVWKFLKKLRTELPYEPAIRLLGIY

SEQ ID NO: 787097 - protein, 98 aa, Homo sapiens
GRNWALGLKTKSKAPLDTWRYRICSNTLSSPPSLFPLLASSLPVSFSQACTCFLHILHLPRASCHVPVRRLSLQQHALLDLLPVHLHARHPKMQPQMQ

SEQ ID NO: 787098 - protein, 77 aa, Homo sapiens
MLVFFTDFSSQLLLLIVEGFKLRIHEQDVLWFQVCMGQLILMQKSKGVAELVGHVPDMWKGVRLEVILLQELKGVLA

SEQ ID NO: 787099 - protein, 170 aa, Homo sapiens
PQAPMGPAPGIPPWGARVPTPQAGAFPPGTYGTSPGHSSLGGEGAHSSGWCIPPGTYGTSPGPSSLGTRGTHTSSWCLPPGTYGTSPGHSSLGGRGAHSSGRCLPPRRLQDKPWALLPRDQAPTPGRPPSPEGAQRPLRCPSPGPFLRPNFDPVSLKMQETSQGPRGGSK

SEQ ID NO: 787100 - protein, 127 aa, Homo sapiens [sequence omitted]

SEQ ID NO: 787101 - protein, 101 aa, Homo sapiens
EVRPNHTTVMDNCLLQERGGVLQEKVPEIVSVLRSKLQEAQEEHVLPNDQHSVYLLATQQLRSRGVQPPGQPLALGQVPSSDSRLRGPSGMMLPLLPSALG

SEQ ID NO: 787102 - protein, 124 aa, Homo sapiens
ILGAHCCTSQSCWPLEALELANSLLPLCFPPVLASGHDVKCSFVTVTNSCGWQAGVFRHQGVYHTHWAPFSGSALALPLLSTLDSSFLGPSPHAWLQPPSMTPTSTSPGPVSLPSSRSVSPNAS

SEQ ID NO: 787103 - protein, 102 aa, Homo sapiens
GGCGVDSISLLFPASMAAAFLALALYPSGLCRGSCVACSDPDLLEGPCDYIGPTCVIQNPCKTPISKSFTSSHAHSGFAPWSHMLSGSRNESVGISGGHCSA

SEQ ID NO: 787104 - protein, 145 aa, Homo sapiens
MKFVKKKYPENFNFNLLYADFWLESGVRTVSPVVQMRLLVPGKFPQPANPFIFFFFFSRQSLALSLRLECSGIDHSSLQPSHSGAQRISPCLSLPELAGTTGSVPPVLSQFKKLFRDVVSLGSPGVFLISRAQAILLPGPPKVRG

SEQ ID NO: 787105 - protein, 100 aa, Homo sapiens
KTTLRSIEDQPSAFNPFHVYKAFSENMLDQSAITKWNWNWAKLLPNYLRLDKMTFSVLLKNRWEMKKDETLEEEEKAILEHLKQICTPQNSSASDNIEEQ

SEQ ID NO: 787106 - protein, 103 aa, Homo sapiens
NIVFDSIFMRQVLALPLRLKCSSMTTAHCSLKLPGPSNPPASETGYRYVARAGELLGSSNPPSLASRVAGITGMHHHAQLIFVFLVETGFHHIGQDGLDLLTS

SEQ ID NO: 787107 - protein, 115 aa, Homo sapiens
MFVSQAELPCVKRILQFFLSLYCKPQHNSKCCRTLRNTSISRKQHWNKHACKSRVPPAKHLTNPACSLLAKGALPSTTCPFVARWSRNPFSPFSNCYTRPCENITDLQEWWGMPL

SEQ ID NO: 787108 - protein, 113 aa, Homo sapiens
MWCRKVAGSPFPVSLGEVRLAKSVVSCPQVRRRLPTSDVGILALLLLLRLPVVEVVEVGDDDGHRQGNGEDPSDGTQRAHDLSPHSHGVHVPVTLPWSCVTTAHQNPCRDAGK

SEQ ID NO: 787109 - protein, 123 aa, Homo sapiens
IFPFHPDPSGARGRSPGCGSRAGPAALLRQDCRVSVTVSRILRGTDVSSGPTRPVGSADTDFPEKVLLPFPALVGKLGREKESHRPGPVGTTEAAPGPGATSEWGKEAGGRAAEPRPSRARGR

SEQ ID NO: 787110 - protein, 146 aa, Homo sapiens
RRSLVLLPRLECNGVISAHCNLCLPGSSDSPASASPVAGTTGACHHVRLIFLFLVEMGFHHVGQAGFESDHSSYCLTLNFLFAEKVEVERMGRSENHAQTTGCHISGLVVKIQPLTSPIVLSINSRHCIKKHYEIPFSVLFHSDYQ

SEQ ID NO: 787111 - protein, 124 aa, Homo sapiens [sequence omitted]

SEQ ID NO: 787112 - protein, 147 aa, Homo sapiens
DLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDA

SEQ ID NO: 787113 - protein, 87 aa, Homo sapiens
TRTDMRRHAHTQTHTHSDTLIHPYITHRRAHTLMHTYTHTKTGIHRHPEYIAHTLTDTHRYTGTHTVHTDMHTHSQICTSHRHVQTY

SEQ ID NO: 787114 - protein, 140 aa, Homo sapiens
TRAPWRRGLGLQGRGPEPPGGGASGSLGAGPQAVWGRSLRPAGGGASCLRAGPRAFWGWGLKLQGRGLEPPGDGAICWGGGSRTAEEDRSAFASSRRPAAQAGTCHLYACFPVDKSRDITLIISSSVHNIHICNPLVKQL

SEQ ID NO: 787115 - protein, 43 aa, Homo sapiens
MTLRRVVMTLGCVVMTLRCVVMASLRCVVMTLGCVVMTLGCVV

SEQ ID NO: 787116 - protein, 82 aa, Homo sapiens
LVDLCINSYSHFTATHFPAVIGDRGEMEFESSEHPSGYPILLFHSSCTPEKLGSLSGGGGKVTIHLPPGVGKESDSTKKSDR

SEQ ID NO: 787117 - protein, 110 aa, Homo sapiens [sequence omitted]

SEQ ID NO: 787118 - protein, 168 aa, Homo sapiens
DGDDGDGADGADAAPAHSERSPRERLREQEAEKTGACAAARTTAPEHRVQARLTADCRSESNPRRPAGGIPASSSLKPKPESHTLHAPAGLDPRLGGPEISTFCKDALLIQKKKEINTKVESEKRKMQVKGPSSTSLPWDPRLQVARRGRCWDRGPAQDRLPLAPPGG

SEQ ID NO: 787119 - protein, 260 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDCSSFKRNTEFGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKH

SEQ ID NO: 787120 - protein, 395 aa, Homo sapiens
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKH

SEQ ID NO: 787121 - protein, 395 aa, Homo sapiens; identical to SEQ ID NO: 787120

SEQ ID NO: 787122 - protein, 134 aa, Homo sapiens
MGLAPRPLTPQVPDLCTSQQPLEWIPGYVYKALEHTVGLRSTGISAKTQNANRTLHHYLQLDSDRRRHCMFKGTRSCFQPRSDVLHSALCELAGGETTAGERTGLFVPSMASEASLSPASRAPDPNFLLKTDAA

SEQ ID NO: 787123 - protein, 109 aa, Homo sapiens
PQAWSANHLIHSSLRLFIELGKIFSSGPRIRLMLTRSCLEGLSTIYCIQLHTINNNVAAFLKIHVGNVRKCKENFISYFILHLQSPHHLQKEYNDHFLCLFIFEQSSQH

SEQ ID NO: 787124 - protein, 47 aa, Homo sapiens
QKGLIATICAGPTALMAHEISFGSKVTTLPLAKDKMMNGSHYTYSEN

SEQ ID NO: 787125 - protein, 143 aa, Homo sapiens
MAPSTAQLLKLSMILLIIATFTPPVNLLDTPPRTRCILNSLLLFISLVRSDETALPSSLGHSLEQSSNLLACFPAFTAPLLEIILCTGAKGSLKTWIPAGHGGSRLQSQHFGRPRRADLLRSGVRDQPGQYGETLSLLKIQKN

SEQ ID NO: 787126 - protein, 72 aa, Homo sapiens
HLTAAEHLEPLEDPRTLPGLRQRSHISVCVSPFGEVTHSAIFSNLENTEMLSSNFGMLSTFCSSCSASPGLL

SEQ ID NO: 787127 - protein, 133 aa, Homo sapiens
MARRFLTVTTTLGGPASFTVIRRVTSCHRGVAPGSHWVSMGQEARSNSRATCHPHDLYRVVSLDRGFCCVFSSNLEGICLEYWIHSPMIPNTATRPTQAAGPSGACSQKKGGVHRCSHCIKARACICEFYTVR

SEQ ID NO: 787128 - protein, 70 aa, Homo sapiens
LPQVLLAGTSGANCASHITLEEEIARMLELDSEWKICKSTECQGGSAGLGAPKEVYPELKLGGCMLGAKM

SEQ ID NO: 787129 - protein, 37 aa, Homo sapiens
PFALCCVYYMYWLLADPFLQVKHCVKAYEKQLLFKKK

SEQ ID NO: 787130 - protein, 75 aa, Homo sapiens
VRAEDPTAEGTMATYKVEAYTKTGYMLGHKISLGYMSVKTAILQKMFSDHNEIQLETKISRIPKYLDIQHFDNNT

SEQ ID NO: 787131 - protein, 100 aa, Homo sapiens
MPCVLKGSSIWRLGVGTHHPCKDGIRLKLLGPDFRNELQQNARTLLEHLPFPPQLKSFPDSSVSLGFIHFPPALLFPSCFWAVSLAITRFSLTPGPLHMP

SEQ ID NO: 787132 - protein, 30 aa, Homo sapiens
MVRGDSPRVGASRNRISAPVYSGYTGPVHL

SEQ ID NO: 787133 - protein, 88 aa, Homo sapiens
PGLKDKGEKSHDHMNHQKKGGGRDRAEEDMNSGTLSTLLIDVTGGMFLWTFKVMDHSPVAIQLSTAGALVGLESSILVQASVCSQWAY

SEQ ID NO: 787134 - protein, 133 aa, Homo sapiens [sequence omitted]

SEQ ID NO: 787135 - protein, 96 aa, Homo sapiens
LFKTLVRSIFYRGETTLACIRYKLTSEDKYDILPPDNYYLVTEDDRETVYFTLAGLEKLRVRSQVMQDYLMTDGEVRGVDTGGNSLVGQNISTTKY

SEQ ID NO: 787136 - protein, 390 aa, Homo sapiens
MLSRKGIIPEEYVLTRLAEDPAEPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 787137 - protein, 106 aa, Homo sapiens
RETLPAFHGKFSGHTSRRGAGAKPVLSMQRGSAGRPQHPPSALGPQSSSVILLGSPTRDFICRFKYNIPILETHRGPGILQPLGTRQRGATCTYVSHLPGSLLSAG

SEQ ID NO: 787138 - protein, 36 aa, Homo sapiens
LDDESETLSLKTNKQTNNQQKENQCVEPISICVKNK

SEQ ID NO: 787139 - protein, 88 aa, Homo sapiens
SPPGLTQRSATLLLPSIFTSWSNPEISHPPPTRVSSPPGLTQMISQPSSYPSIFTSWSNPEMISQPSSYPSIFTSWSNPEIISQPPLT

SEQ ID NO: 787140 - protein, 107 aa, Homo sapiens
MGPSCGVRALGGDTLGFIPQGLGLLQWRLGRDEVGPKGLEAGAETFSKADAASPDHLDVTGAPAAPDACAAEAGQGQDPLKSSSASCLSLNRGALAARAAGLLSASR

SEQ ID NO: 787141 - protein, 107 aa, Homo sapiens; identical to SEQ ID NO: 787140

SEQ ID NO: 787142 - protein, 106 aa, Homo sapiens
MHSNHHLRLLPPFLTYMKSAWTPLSPFLPSLLPPFLLNRIRALNSIWTVSYIGHQDVISLFVSGNCSLDPSVLSETSPKPTRRKPSSVLSGFCFQYMLPFLWSAQS

SEQ ID NO: 787143 - protein, 91 aa, Homo sapiens
ACPIPRTPETQNTGDIEAKSRVFGHFGRSTRAESAGGLQRPKVHLLLTVCSSLLPPPALHRLKSRRPLYRRQLQLLRRKSLAFPFLAPLHT

SEQ ID NO: 787144 - protein, 223 aa, Homo sapiens
MHPSTLPLLLACANEHIPLPPSLKALWLAPPIEILWLVVQEHINLSGTAGVNVNYFSQHGKQFGDFSKNLKQNCHSAQQSHYLLSTQRNTNVSAIKTHARIMFITALFTVAKTWNQPKCPSTVDWMKKMCHIYTMEYYAAIKKNEIMSFAATWMEPEAIIPSRVTQKQRNKYCMFSLTSGSQILSEDGHTERNNRHEFLPERGGWEDGDDQITTNHVACFLPE

SEQ ID NO: 787145 - protein, 124 aa, Homo sapiens
PFTQTSRTQGRCSSAHWQGCHPHPHPQPPNRTRTAQEKKVAASLMGPSMAPTEHRQLDSAVGGQTYVLGQVELSPDTRGCFILRGSSAEHQQLDPTVGGQAYALGQVELSPDTRGCCILRKSLS

SEQ ID NO: 787146 - protein, 137 aa, Homo sapiens
FSTEIPHPGKPMRLATLRDCTLHRCGIVQSHVPLSQNRPVLGLMLCYCHLQFLVIFQQGVLRFFALGLAKHGAHPDDLSPYILDLTTVLLCKLAFCLLPGGAHCLEGPLQSGSIFPVHILSHHSHLRPSSFLASGLW

SEQ ID NO: 787147 - protein, 200 aa, Homo sapiens
WPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSKWRVAKSPHDQEIKFFAKILLPLI

SEQ ID NO: 787148 - protein, 54 aa, Homo sapiens
SVFVMPPGSLQATSGRAIVSPLWEPSLSHGAWHRAMIWNSHDNTPTAAQRTQIP

SEQ ID NO: 787149 - protein, 114 aa, Homo sapiens
ACRRGFSGQLVFGLWLDGNSSASCHIGSLQLGIKPNNLAFSHPKRKVEFCCIYSISPSLFIHSLKLLCFFKMWVGYNFSSQQLESLKSCRTPLHIPSSKTRFLVPSSIIPISEA

SEQ ID NO: 787150 - protein, 160 aa, Homo sapiens
HAPPQLSDYFLFPFPSLGRDAAATLPWPPTTCLHERLGPLPGPPRPSAVPRGPGRGDSRSPNPLKWGPEERGGALSGDRERAERSWHRAPPFHVAEPRGYDLGGRREGGRLGWRRGGAKVGAGTMGTAPRAANPRTSRRLAGGRARPLLPVPRSPRTGRP

SEQ ID NO: 787151 - protein, 60 aa, Homo sapiens
SNTSLCLRRQTDTHVTHSFSERPQSASEKPPSQQAGSRFPEALHSAQGTLIHAFRLVNIH

SEQ ID NO: 787152 - protein, 119 aa, Homo sapiens
QLRQERLRADKDLKCCVVVIEEQMFGFPILFILLFSNPHHGPIRGHYSVSSALPGTSHAFLSFNLSALSQMRKLRSRQVESLVLCDRAGKVLYDRDLTQRPSPVVTFWMYFVAVLPWTT

SEQ ID NO: 787153 - protein, 127 aa, Homo sapiens
GACCVSRGFLWDGSPPPIFHTALRGSFLRCTSVCVPSVKILNEYSCVPHLTQAFHDLTHTHCDSLLLGPHSQAPWVLARPYAQQVPHQAKCLLLSMLLHLQGALGQKFSFKTARTETHTQTKRETIN

SEQ ID NO: 787154 - protein, 70 aa, Homo sapiens
RRSAMWIDGLTFSTFSYSERVPSASAGFLSHVDYLLLSGKQVGWWPFDVMPASLLEMWVFLEPKAEKAEW

SEQ ID NO: 787155 - protein, 75 aa, Homo sapiens
QYGHQEAPRIHPASTFHGFCQLVNCFCTHKPASPCSGSLHRTRRLLDPSPNLPGSTVLILILSLSHTTKTTTSPI

SEQ ID NO: 787156 - protein, 94 aa, Homo sapiens
AKNLFVLGKCLITLSSSHTRLGSLSEDVRGGTGFKNKNRIMVSASENLLPPRYNGCFQRGPAAVCCVPRSGHEDSTCAVSMYSHTSCMHGRHTL

SEQ ID NO: 787157 - protein, 104 aa, Homo sapiens
MSNRQIPVKTVLCLWSSGRLRPEDNCTFFSCVKIHNQLISSVSNIACPNFDASICIPGSITFMPNGCCKTCTPRNETRVPCSTVPVTTEVSYAGCTKTVLMNHC

SEQ ID NO: 787158 - protein, 110 aa, Homo sapiens
MLALCGCPQMHSFDHKDPEKWAFYTRCLLHTAGEKPGLNSFIWLQSPQSSSTSCCHLRHSKRCHHLPDKQGTESPIHTDAKWQKKYTRKILYADQFGQKQQTMLSANNPA

SEQ ID NO: 787159 - protein, 109 aa, Homo sapiens
MTPAWSIFHPRSLSPPVRPNFIAAKGPKKAACLPRGDPEPGSRHLHVLTPATARPSQALGPWVLSCDGTIAPSIPQHQTPVKSDSPSEVRFSWPFLGPAFRLPLGSPAS

SEQ ID NO: 787160 - protein, 225 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 787161 - protein, 80 aa, Homo sapiens
MFDRENKAGVNFSEFTGVWKYITDWQNVFRTYDRDNSGMIDKNELKQALSGFGELTHSGLCSVFHFGTLEPLKFFKPCWT

SEQ ID NO: 787162 - protein, 225 aa, Homo sapiens; identical to SEQ ID NO: 787160

SEQ ID NO: 787163 - protein, 158 aa, Homo sapiens
MVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 787164 - protein, 143 aa, Homo sapiens
LLLLFSGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 787165 - protein, 822 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIICQRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLARGSQAWQLRLCCPEPLMTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 787166 - protein, 239 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQTLAPSPRPECGGANTAHCSLDPQAQAILTPRTPKVLGSQARVTMLA

SEQ ID NO: 787167 - protein, 246 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIICQRTMIPPGECTYAGRKRRRPLQKQRPAVGAEKSNPSKRHRDRLNAELDHLASLLPFPPDIISKLDKLSVLRLSVSYLRVKSFFQGQGLAVADAEDVDDHTGERRPMSFRRPRALDTQALRRTQFGLHLLMVNIAGLIATDRL

SEQ ID NO: 787168 - protein, 233 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQVTEWLHVGLWWWWEGLACQRDAPDLQSKELGMCRISFWSL

SEQ ID NO: 787169 - protein, 241 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIICQRTMIPPGECTYAGRKRRRPLQKQRPAVGAEKSNPSKRHRDRLNAELDHLASLLPFPPDIISKLDKLSVLRLSVSYLRVKSFFQVKRQRREIHGRNCQKKRNQNLKCLTRVLLGSVPLLLCCMPRTGVGSGRCRRCG

SEQ ID NO: 787170 - protein, 193 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIICKYRQTDQLGLLCIRPAWVPACVSFVCGSVSLCSLLEFHLDERRPFHPSPSVSVPFHISPCMFALFLILFIFNVRCNLSFQFLILKMTYI

SEQ ID NO: 787171 - protein, 200 aa, Homo sapiens
LAAPRPARSWLPRWLPPQDAGLPPRRPEPGSRAGGFSGGGRDPPDTEGRPRRDPAPVAPRPRTMIPPGECTYAGRKRRRPLQKQRPAVGAEKSNPSKRHRDRLNAELDHLASLLPFPPDIISKLDKLSVLRLSVSYLRVKSFFQVKRQRREIHGRNCQKKRNQNLKDRGWQWQMPKMWMTTRANEGPCRSGGPEHWTPRP

SEQ ID NO: 787172 - protein, 115 aa, Homo sapiens
MPRGPCWGRHPRLSTPVAFEGHALLLGLLSSPLRRPSPASLLTSQPLPLCPDTTPSAARSLLVLNSCVAGFCPPPSLLYAQDRGWQWQMPKMWMTTRANEGPCRSGGPEHWTPRP

SEQ ID NO: 787173 - protein, 226 aa, Homo sapiens
TTRPRTRGSTHASGGVGLRGLSSLQAPQPSRVPWPMAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 787174 - protein, 197 aa, Homo sapiens
GDNARPCPRQRRKRSRPERSLVAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 787175 - protein, 231 aa, Homo sapiens
ADSRNLSSGCKVSRSLEAPQATSQCLCGRGAITLYRPGPVVPGLVPVPELRGRIPGPDHSVWNQLFHEGQSKDRSVSDIMTLEHSANALLQSGYVDFPFNPVDCQVLIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 787176 - protein, 157 aa, Homo sapiens
MRPRTRGSTHASGGVGLRGLSSLQAPQPSRVPWPMAAYSYRPGPGAGPGPAAGAALPDQSFLWNVFQRVDKDRSGVISDTELQQALSNGYRLSDQFHDILIRKFDRQGRGQIAFDDFIQGCIVLQRLTDIFRRYDTDQDGWIQVSYEQYLSMVFSIV

SEQ ID NO: 787177 - protein, 676 aa, Homo sapiens
ATHPHRRTYAGTAEQPKYTRWFFLWFRRWKVETIARNVAYPPQRLKDKEGKGQTLARRCSGWSVRALTGRGAAPPGRPLWRPAGAGQEALADPAASSSATPTPRFSHGADAVCRHGTGEAVALQVPPRSRCGAGGCLTDVMHQNIYDYIHVDDRQDFCRQLHWAMDPPQEMMLILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 787178 - protein, 244 aa, Homo sapiens
VIMPGPAPGRGGSGVGLRGLSSLQAPQPSRVPWPMAAYSYRPGPGAGPGPAAGAALPDQSFLWNVFQRVDKDRSGVISDTELQQALSNGTWTPFNPVTVRSIICRGQMIPPGECTYAGRKRRRPLQKQRPAVGAEKSNPSKRHRDRLNAELDHLASLLPFPPDIISKLDKLSVLRLSVSYLRVKSFFQVKRQRREIHGRNCQKKRNQNLKDRGWQWQMPKMWMTTRANEGPCRSGGPEHWTPRP

SEQ ID NO: 787179 - protein, 67 aa, Homo sapiens
HHRHKYRCRRPATPQARPRPSCSQRKLLVQDFPGLNLLIYRLGTNPGVCALGGAHTGNPGSGQIPSP

SEQ ID NO: 787180 - protein, 111 aa, Homo sapiens
PPPVVSCCIVFYCWPSGFPDAPLLLGWFIRFERHAVISSRSQEAANRLVLAPTGLPPCSMSVCARINVYVCMPVNMCACVCACTCGPASPSPTVRARASESPRPVACHRSG

SEQ ID NO: 787181 - protein, 160 aa, Homo sapiens
MEAPPCHLAPAPSVTPLWPGAACCLPVTSQPVGISTARAGSVHLLRHPHPRHTVPSVSSHWAESCHVAAQLQGSPGRVRGPCPADLAACDNAISGPVVTLALLTLPIRLGNGLDSGICEPEVTNVKQHLIHVLAKWAFVKKNNKVWSELNVTIFGQIYVI

SEQ ID NO: 787182 - protein, 102 aa, Homo sapiens
ACYRQDAQLVGGSSCAAALTLGRAGLPSVAGSLGLSSGKAAAQLPCHWVYYLHLSPSGACASVSCAVAHVCSCLSHIGSCHASLELQPWHCWVPGQYIICCR

SEQ ID NO: 787183 - protein, 135 aa, Homo sapiens
CNSTQAQPQLCSACEQGEARQQEHALPSLQGRGLPGPPRVQGCPGLQLQLGGCNCDWEGRASTWSAWKWVGLLPVPGSCWLLRACSLLPCLPCCFWHLCSSCFRQAAAAISRAFIVLSYVPSIPNLMRIFIMKGC

SEQ ID NO: 787184 - protein, 107 aa, Homo sapiens
CGTIVSHHVIVPCRSCRLSCNVGHFWMFHSQAVYDINRLDSTDFCKMPRGELGLFLFSNCLLQSDGKLTTNSCGEKKRRSRPKNRVYSPRERRPAFQCYFICFYNWM

SEQ ID NO: 787185 - protein, 145 aa, Homo sapiens
EARSRQESCTAKEGVVPEYSVHWGLRWEERVWARTSLGGALFALPGRRDHTLWSLGHHQRFVRMEVMSPGWHLWLSLCSRMEEGRIRTLGGAKHPTGGVLLEPPGRARRGVGSLNSVAVGPKGQGMIHEWSAKRERQRERWGDYL

SEQ ID NO: 787186 - protein, 64 aa, Homo sapiens
HRSQALRVGVLCRFSPNNSNPIIVSLAAQRWSLDSAPCHCHRRPRQTEPPPLGTSLVPMKQKGE

SEQ ID NO: 787187 - protein, 135 aa, Homo sapiens
PPPANKGQRGGVDTMSEGAYQRLWESSHATLQELLDQEQLLLEPAPDRERQSFQYRLASLYLHYLGLLRRFDTVYDQMVQPQKRRLLRRLLDGVAGRVLELKDELVRADLCENHCLDRVLQDFKLTPVRVRSREA

SEQ ID NO: 787188 - protein, 143 aa, Homo sapiens
ASMATSRICSHSSQRNYLKTSIGHIPPLLKIFSCRQRPKCSPWPRKPFPILFPLPSTPALSPLHSHSFSHTDLLPLARTHVKHAATSGPLNAPPCARTPFLQNPQGLLHSDMTSSTRPTEYPLHPSPSPDHFLLIFLHRTSQV

SEQ ID NO: 787189 - protein, 154 aa, Homo sapiens
GGTNCETPRATCLDQCSGHGTFLPDTGLCSCDPSWTGHDCSIEICAADCGGHGVCVGGTCRCEDGWMGAACDQRACHPRCAEHGTCRDGKCECSPGWNGEHCTIEGCPGLCNGNGRCTLDLNGWHCVCQLGWRGAGCDTSMETACGDSKDNDGG

SEQ ID NO: 787190 - protein, 137 aa, Homo sapiens
MQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSKDEGTEL

SEQ ID NO: 787191 - protein, 103 aa, Homo sapiens
MGNILTCRVHPSVSLEFDQQQGSVCPSESEIYEAGAEDRMAGAPMAAAVQPAEVTVEVGEDLHMHHVRDREMPEALEFNLSANPEASTIFQRNSQTDGETTVS

SEQ ID NO: 787192 - protein, 93 aa, Homo sapiens
MGNILTCRVHPSVSLEFDQQQGSVCPSESEIYEAGAEDRMAGAPMAAAVQPAEVTVEVGEDLHMHHVRDREMPEGKEVIGAIYPRFAFGCCCP

SEQ ID NO: 787193 - protein, 135 aa, Homo sapiens
DGAKAGCPVSHLREASWGQVLTEAGRGGPAGGRKEGSMGQGGWGYPGPAWSFILSLNLGLSGDLKMVPHKLTASCLELRGAPPTGTFHPSEPAATGGPRAERLSPGAPFPEGLCPVCVERGQLPDTIHKYCMEHT

SEQ ID NO: 787194 - protein, 67 aa, Homo sapiens
VNTTLLFCPFQGSDEPSPADGGRDSILSPAIYTLYVHSCLYCRVAKGNCRVCRWPGRAAQSPPRTQV

SEQ ID NO: 787195 - protein, 122 aa, Homo sapiens
MGQACSLHRQPHPVSTQGQAPARAKAPALSQRCCCPWPGMGTWASVSGKLRKFLDIQFRSYIHAFSVLRGQLGVTHFIRTNSGKLRIKLTCKSVVYCSSVSNHVYLDAILYLRSYSKTNSRN

SEQ ID NO: 787196 - protein, 118 aa, Homo sapiens
VGLGAGAITHCPHIAWLQMLIDQTSTLEAPTSILQVGGAGGRDGKCMPLLGARWHQCGHSGSLQGTVSWLAWIRGGAEQMQVRQQTACSVDKSFCRPLRNDSSLIPRWGICLPLAGLG

SEQ ID NO: 787197 - protein, 87 aa, Homo sapiens
IVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 787198 - protein, 90 aa, Homo sapiens
AGGHSSYSETQTHPLAAGDCGNFLLPPTGTSISPPIPSPSAFTCRRRRCRCVLLLSLQTEQMIRLLGYNVIWVQAEPLVEALGKRHSISS

SEQ ID NO: 787199 - protein, 72 aa, Homo sapiens
PRSTVFCQTHLLPRHRPSHCGSRICARPSFVKEDKIRAHVTGAAVTLSLCVLSDEGSGASPASCWEKKGGSK

SEQ ID NO: 787200 - protein, 115 aa, Homo sapiens
ILADEEVRLHIACLMASKGQSWDLNQVLEAPTIALKGSALLSRGHLSLVAQQSGCDISYKACQEERLPIPDSEAAAPMSPPQTHCASLKHSLPFIYLQVTNSEFQWLILLRDRGL

SEQ ID NO: 787201 - protein, 163 aa, Homo sapiens
MDKIYEGQVEVTGDEYNVESTDGQPGTLTCYLDAGLARTTTGNKVFGTLKGAVDGGLSSLTVPNDSLVMILKARNLMQKYTGSTSRARMLQYMCYLMEEDEDAYKKQLSQYIKNSVTSDMMEEMYKKGHATIRKNPVYEKKPKKEVKKKRWNRPKMSLAWKKG

SEQ ID NO: 787202 - protein, 128 aa, Homo sapiens
SSPELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPV

SEQ ID NO: 787203 - protein, 109 aa, Homo sapiens
LRVIRAACALLNSGGGVIQMEMANRDERPTEMGLDLEESLRKLIQYPYLQAFFETKQHGRCFYIFVKSWSGDPFLKDGSFNSRICSLSSSLYCRSGTSVLHMNSRQALY

SEQ ID NO: 787204 - protein, 108 aa, Homo sapiens
MEMANRDERPTEMGLDLEESLRKLIQYPYLQAFFETKQHGRCFYIFVKSWSGDPFLKDGSFNSRICSLSSSLYCRSGTSVLHMNSRQAFDFLKTKERQSKYNLINEGS

SEQ ID NO: 787205 - protein, 104 aa, Homo sapiens
MGYVVKSRTEQVDWQGCLSRAGRELALGQQASSDRAQIPVPTIEVLILPCDRYHFLSKVPSDFFLERGWGRIVGSRDVLAGIAIISFSLVSWIQIHLLLPPSLT

SEQ ID NO: 787206 - protein, 81 aa, Homo sapiens
PGTVPAAQSPGNSACSSVGAWYSTYSSDTRKQCLQLSRSLVQNRPQQFQLSGTWSTQKDLISAVEIFGPELNTALILPNKR

SEQ ID NO: 787207 - protein, 75 aa, Homo sapiens
DYGGVVFCIFFGIIYGMVGALQFEVLMAIVGTHKFFQIGLVLLMEAVAVLVGPFGRGPAVTQAGGQWHHHSSLQP

SEQ ID NO: 787208 - protein, 104 aa, Homo sapiens
GVLSDVTDGVLSDGTDGVVTDGVLTDVTDGVLTDVTDGVLTDVTDGVLTDGVPTDVTDGILTDVTDGVLSDETDGLLSDVTDGVLTDGVPTDVTDDVFTDTIFL

SEQ ID NO: 787209 - protein, 70 aa, Homo sapiens
EEHRGRGWRRKTGDAVSGVPGEGRMDRRDGSEVGHEASRKKLQRTRTRVPEPGVGGFRNRREVGNGKGVW

SEQ ID NO: 787210 - protein, 110 aa, Homo sapiens
MGQAGAGYSRSQAWRMWGTRAGTKCRGINLASGGQGPMPQRPSSVSTPHVRGARPQLHSDLLVDSSQIFDEGGRLYYCYYTVCTDRETEFQRGQATAPKAQANKYSSEQR

SEQ ID NO: 787211 - protein, 86 aa, Homo sapiens
GLDTLKLLWVPDCPAGCDAGPACSGMLSSPSPAIPNLNIQQIAINGEPAIWKDFFKCREPGSPPLSPLSSLCPFMVFVPSLLAVPQ

SEQ ID NO: 787212 - protein, 104 aa, Homo sapiens
LHCLDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPD

SEQ ID NO: 787213 - protein, 189 aa, Homo sapiens
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNDKGDVVLFLASFKDITDTKVKITPEDTTEDKVKGRSRAGTHFDSARRRSRAVLYHISGHLQRREKNKLKIN

SEQ ID NO: 787214 - protein, 113 aa, Homo sapiens
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGVCFLSCSLE

SEQ ID NO: 787215 - protein, 80 aa, Homo sapiens
KISRLDAELVKYKDQIKMRGGPTKNMITQKALRVLKQKRMYEQQQDNRTQESFNMKQVNYTIQSLKDTKNTVDAMKLGAK

SEQ ID NO: 787216 - protein, 43 aa, Homo sapiens
SRSISKSRSRSRSRSKGRSRSRSKGRKSRSKSKSKPKSDRGSH

SEQ ID NO: 787217 - protein, 132 aa, Homo sapiens
VHNPWCLLWHTAGPGGWAGRAVCRSFSCCITSHGSCSILTLALQQGCAAPAHALISQRDAIKLSPSSPGCVTTSHHPGARSHRQLSGFCQHGPSLLTMLSSALGSSRRFCSVACAGAGVFTGAAEQVPTLPL

SEQ ID NO: 787218 - protein, 137 aa, Homo sapiens
MQNLNDSLVSYLDKARALEEANADLEVKIHDWYQWQRPAEIKDYSPYFKTIEDAEEQEHNGMVSADDTHGLSLWEHLKGVRLQILVHLGRTQEGREVQTYVWPWGTCHPLEPVWSLPAHPQLEFWAFSPAHRWDLVN

SEQ ID NO: 787219 - protein, 50 aa, Homo sapiens
EELWQEDPYEYICMKFDVFEDFISPTTAAQTLLFTACSKRKEVLQKTIGF

SEQ ID NO: 787220 - protein, 66 aa, Homo sapiens
SARYRQTLNYVQNTPNSEIIFNFFVEMGSPHVAGWSQTPRLKQSSCCSLPNCKDYRHEPQRSVLML

SEQ ID NO: 787221 - protein, 117 aa, Homo sapiens
MLEAILQAFPFFIALAAKDNYMVSYQQNVNSPSAHEYILAQRKTGEKYVKRTCNTSLHIHGRGRPGASFSYKIGKIAPKPAGLLRLTLFRMALNKHLAQEMPIISHLFPFMSQSQMW

SEQ ID NO: 787222 - protein, 108 aa, Homo sapiens [sequence omitted]

SEQ ID NO: 787223 - protein, 73 aa, Homo sapiens
SANRLPKEKGIKILGEQTNELFTCSACMKSRKILIPRNCILIRLKQNKKASKQVELYFLIEIYTAILKDKPEI

SEQ ID NO: 787224 - protein, 91 aa, Homo sapiens
QSQAQGMMGNSEGEMWAPWDPTLCPPQSSSPSTPSPVQQAQLRLRSSPQELERQALAKHVRAEALSSTLRLAQDEALRAKNLLLTDKMKPE

SEQ ID NO: 787225 - protein, 592 aa, Homo sapiens
MASVVVKTIWQSKEIHEAGDTPTGVESCSQLVPEAPRRVTSRAKGIPKKKKAVSFHGVEPQMSHQPMHWCLNLKRSSACTNVSLLNLAAMEPTDSTGTDSTVEDLSGQLTLAGPPASPTLPWDPDDADITEILSGVNSGLVRAKDSITSLKEKTNRVNQHVQSLQSECSVLSENLERRRQEAEELEGYCIQLKENCWKVTRSVEDAEIKTNVLKQNSALLEEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPEEKMATLDHLHLKMCSLHDHLSNLPLEGSTGTMGGGSSAGTPPKQGGSAPEQ

SEQ ID NO: 787226 - protein, 541 aa, Homo sapiens
MASVVVKTIWQSKEIHEAGDTPTGVESCSQLVPEAPRRVTSRAKGIPKKKKAVSFHGVEPQMSHQPMHWCLNLKRSSACTNVSLLNLAAMEPTDSTGTDSTVEDLSGQLTLAGPPASPTLPWDPDDADITEILSGVNSGLVRAKDSITSLKEKTNRVNQHVQSLQSECSVLSENLERRRQEAEELEGYCIQLKENCWKVTRSVEDAEIKTNVLKQNSALLEEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPE

SEQ ID NO: 787227 - protein, 138 aa, Homo sapiens
KIHYFSVSLDIFCYNRESCVDRLMASVVAISVSLDCCNKLQQTGWINTTEMYFLTVLESRSLHQGASRAMFLLRTLRENLSSPHPGVVAPSGPWCSLACSFITPISDSFVTCVSSMSWPVSTQARSVSAVQKPRQLSM

SEQ ID NO: 787228 - protein, 140 aa, Homo sapiens
LSLTLSPRLDFSGTISAHCKLHLLGSSDSPASASRVTGITGACHHAWLIFVFLVETRFYRVGQAGLELLTSGDPPTLASQRAGIAGVSHRVWPYTSLLKPALPFPYAIEALGRGGGGNGTGIHHLILVPSLTCLLFINAY

SEQ ID NO: 787229 - protein, 92 aa, Homo sapiens
IDILQEKEYVVDKPNGEISLKAWTYSSTTTTWKWLRSSWKPDSEASEVISILVALKTTDIHELGRVCNIKRYGLRRGPRGTWTLFHGAESEK

SEQ ID NO: 787230 - protein, 118 aa, Homo sapiens
LGTLQQTTAEALDFPVFFSQYFPSIMKEITGFSLLHSPHSTAKSCSFYFLNMPNPNTYMIFNYTQISWPFMVQSCFWHKTEGVAWPCLPLQPHLLTPPREGFISKALFTCGAGSLLGR

SEQ ID NO: 787231 - protein, 76 aa, Homo sapiens
PVCPGSVCALQGEKQELFGTLVMGNGAPLTAAPQTGSSLQASAQNPCAMPQETQCSPPAHATVGRENYYEALCLLI

SEQ ID NO: 787232 - protein, 81 aa, Homo sapiens
PGCTSCERAGQAVGRRGKRLLTPWLQQGEAAAASAEERRWERRAQAWNLPKAGLELLTSGDPPTMASQSARITGVSHRTWL

SEQ ID NO: 787233 - protein, 81 aa, Homo sapiens
TFSRHSTFSPVPYFPPGIAVSHLVALWVIRPPDTAVLVFRQLSFHLIMAQNTTVVRYYFLIVEPPVTETMESENKDKDGLP

SEQ ID NO: 787234 - protein, 32 aa, Homo sapiens
HHHITKGSCTTVPFTQCAMSSPQENNYSTLNG

SEQ ID NO: 787235 - protein, 70 aa, Homo sapiens
MRGRGPHNPKIKMPPESFPGGKRCSPKHSFLPSFNKRVQGHGSSNPSPIPLPLQNVKAQTTSVTSNTAFL

SEQ ID NO: 787236 - protein, 105 aa, Homo sapiens
RRWPLLLTALTFLDDWGQGLPGYFRVSSRASPVMHLWIGLVNVAVAREWTTDMSTAGATWWLVLGCWFLELLRGPVGPFEVGSQPLPFRFPQGCVRNRRTCSLVY

SEQ ID NO: 787237 - protein, 103 aa, Homo sapiens
MAESSAYASRRMDASNIAFICASSYEHRARPILRSHFSTQKPETSVIILLSCEYSNERFIGLCRSHEAKYHSEGPLVNYKTYIIRIPYIGTDLVAMNAEEATQ

SEQ ID NO: 787238 - protein, 67 aa, Homo sapiens
INPLIKLINRSFIDLPNPIQHLRYDETSAHSLGLPDPPNHHRAIPSHALLTRRLNRLFINRATSLET

SEQ ID NO: 787239 - protein, 52 aa, Homo sapiens
LPGEPGSTRLSKEGGTRPRPDTEQVKLPVLGDGGTAPASNACSSARDIRRDP

SEQ ID NO: 787240 - protein, 76 aa, Homo sapiens
WAGKSDRVLCRRDQHGRTCSGCGHREVTPSPRDSGSHTGWSEAEQWKDRWVGSGDHGNSRRDPSPWFMGRTRTPLS

SEQ ID NO: 787241 - protein, 113 aa, Homo sapiens
SLCEAEDRYRTELAQMQSLINNVEEQLSEIRADLERQNQEYQVLLDVKARLQNEIATYRNLLESEDCKYVPCCLCQHRVQKQITSLGNDLKGALEARWGWHCRSHLWRQTCYH

SEQ ID NO: 787242 - protein, 75 aa, Homo sapiens
SLCEAEDRYRTELAQMQSLINNVEEQLSEIRADLERQNQEYQVLLDVKARLQNEIATYRNLLESEDCKNGRWTRT

SEQ ID NO: 787243 - protein, 46 aa, Homo sapiens
MQPQARSTKDCWQPPEARRRHRRTLPERLQRERGLADSWIVDFQPP

SEQ ID NO: 787244 - protein, 104 aa, Homo sapiens
MGVGSPHSAPIATLTASAGALSSQHLHSSLFPDLAGTQCNVKAGVRAHPAPACPHIHTVHTITHTHPHTCIQFIPSHTPAHIHTVHTITHTPAHMHTVHTVSHT

SEQ ID NO: 787245 - protein, 94 aa, Homo sapiens
IRSQGFVDCGWGGLRGLESRRSLSSGIFYMKECPPHVLKLLCRTVGSQWSPVPCQLAQACPLVSDDPSLKVSLSFDGHLCLGGYTALVKPRQPC

SEQ ID NO: 787246 - protein, 180 aa, Homo sapiens
MHARPQSCELADLEKPLSALSARLPGASVIGKVRKALQEEFSAGCWVRSKGELLPHLLLGVCGGRHKDHLCLCLPLLLARSVFSLTRNTELDNLCLGLSIRKIRLETPPLLIFPLYGSRIFVFWSSHMDLAVLIPPTLLSKKQDSLFGSPQGYGTVGPTPGTCGWLRHRFGPGTLCWNGL

SEQ ID NO: 787247 - protein, 113 aa, Homo sapiens
QVCLLYQMGGCSASTPVGRMRGCHDFQGGVRTCLPGLCREGFGVEIGRPRNRGVSGASAGGQAQMRMEAAQCHSVCTGNGGSQGQGSAWCQLCDPGHAAEPLWAPVPLFVQRE

SEQ ID NO: 787248 - protein, 118 aa, Homo sapiens
QASAGLYVDRLIVLCMVSEGTATKFSVWGASAALEGVRLKPTRKFAYLGRLAHEVGWKYQAVTATLEEKRKEKAKIHYRKKKMIRIIFFFRLPAVGPGGAAARVVFQQGPPGGAAASA

SEQ ID NO: 787249 - protein, 83 aa, Homo sapiens
ECSEPFHPPITFVPRPHLPQFFLKLSSSEIQNCRPQNHSFSQSGSLHSRKVAPCNLAEQESGSMGLLWSCRLKRAPAAEADPS

SEQ ID NO: 787250 - protein, 79 aa, Homo sapiens
KRQPQHLAEEAFLWNERKYGSKGSPCIPISSPLTTHLLPLGPPPNTLSLQTSVCSKVATRILKLPLYNKTKLLQLVATI

SEQ ID NO: 787251 - protein, 39 aa, Homo sapiens
MQGAEDRLLSKEEREEATEMEKGPGQVSGEMVRAWRGGA

SEQ ID NO: 787252 - protein, 158 aa, Homo sapiens
GRSDGFERSLQEAESVFEESLHLEQKGDCAAALALCNEAISKLRLALHGASCSTHSRALVDKKLQISIRKARSLQDRMQQQQSPQQPSQPSACLPTQAGTLSQPTSEQPIPLQVLLSQEAQLESGMDTEFGASSFFHSPASCHESHSSLSPESSAPQH

SEQ ID NO: 787253 - protein, 429 aa, Homo sapiens
METQFRRGGLGCSPASIKRKKKREDSGDFGLQVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 787254 - protein, 200 aa, Homo sapiens
ICSLFYTMESLRELHIFDNDLNGISERILSKALEHSSCKLRTLKLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVT

SEQ ID NO: 787255 - protein, 189 aa, Homo sapiens
LYCLDYCCHLRTLKLSVQRIFQNKEPLIRPTARLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVT

SEQ ID NO: 787256 - protein, 176 aa, Homo sapiens
MPTLLTQVTTGMPTLFTRVPIGMATLLTQVPIGMPTLLTRVPIGMATLLTQVPTGMPTLLTQVTIGMPTLLTKVPIGMPTLLTQVPIGMPTWLTQVPIAMPMLLAQVPTAMPTLLTQVTTGMPTLLTQVPIAMPTLLTQVTTGMPTMLTEVSLLECPHCSLKSLLECPHCSIKSIM

SEQ ID NO: 787257 - protein, 97 aa, Homo sapiens
IELGPPYRWPMKDGKVGALAACRSPARLRKLRIMAEGKQAVCRCLEKEEESEGEVLCTFKRPDLRRTHYHQNSKGDIRSHDPIISHQAPPTLGIIIR

SEQ ID NO: 787258 - protein, 209 aa, Homo sapiens
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 787259 - protein, 115 aa, Homo sapiens
GLGTRLGVGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 787260 - protein, 194 aa, Homo sapiens
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVPPLFRLEKGPPRGPLAPTGEKAH

SEQ ID NO: 787261 - protein, 209 aa, Homo sapiens; identical to SEQ ID NO: 787258

SEQ ID NO: 787262 - protein, 91 aa, Homo sapiens
RRIYCGLGLLQMIESIGGLLGPPLSGYLRDVTGNYTASFVVAGAFLLSGSGILLTLPHFFCFSTTTSGPQDLVTEALDTKVPLPKEGLEED

SEQ ID NO: 787263 - protein, 77 aa, Homo sapiens
ERCAGSVACRNTHNLCGPGKEQGTVHEKCHRLNRNGTSSALFSSWIGNEGAINLEVRKMNLESLNPALTGRQLRECQ

SEQ ID NO: 787264 - protein, 281 aa, Homo sapiens
GAGAGRSPAARQVAPPGGPSSLARTHSRRHPDHAPPPGRPSCSRPLCAGSSCLATPEPARAPSIAEPGPGIPVAAIKPVILPGGGGCTGARTENPPLSPTRGDCRVPVPAAQISLRWRSGREARPGGPQAGRAGDPKADQAMHLQPAWAPKLQPPSVCRQQPPGNSRARPHSPHLGTRARCPCGCGEARRSALQQLHGGGNRPSAPSRVAVEDPWLEVSSSGRGGPGRGQGLAGSQARGTRDPEAAQAMLHHLGAQLQAPGNFQAGWRAQPRRTGARCRRD

SEQ ID NO: 787265 - protein, 113 aa, Homo sapiens
YWHLLDRSQGGQDGNKHPTESWAQWRAPVIPATQEAKARGLCEAVVSYDCICKQLLHSGLGNIVRPCLLNKRKHPTVHRPPPTRSQNVCHATACQGWETRAKGAHFCIWFLQG

SEQ ID NO: 787266 - protein, 106 aa, Homo sapiens
MFQGRETLSTGSFQGDAFPWKPDWTPGLQRRWRGWASPKEILGNFQDFQEPRGLERSHTRPAPGRPGQRDWRGLSWRPSAIARRRPRAPGPWAPSLRGTHPGAASQ

SEQ ID NO: 787267 - protein, 228 aa, Homo sapiens
QYFKNHNVTTIIRLNKRIHDAKRFTDAGFDHHDLFFADGSTPTDAIVKRFLDICENAEGAIAVHCKAGLGRTGTLIACYIMKHYRMTAAETIAWVRICRPGLVIGPPQQFLVMKQTSLWLEGDYFRQKLKGQENGQHRAAFSKLLSGVDDISINGVENQDQQEPKPYGDDDEINGVTQGDRSRALKRQRQSKTNDILLPSPLAVLTFTLCSVVIWWIVCDYILPILLS

SEQ ID NO: 787268 - protein, 33 aa, Homo sapiens
MVGSKESEDPKPRPQKEEERTVNMELGQQGPGC

SEQ ID NO: 787269 - protein, 104 aa, Homo sapiens
DIDEHVDTHHTHLYICTMPSHIHICAYTHIHIYHTLTHITHNTCIHAHIHTHITPCLHTYYTLAYTTHTYTQHVHTRCTHIVPYFPFNWPQYEPSLFIHSANVP

SEQ ID NO: 787270 - protein, 67 aa, Homo sapiens
GIATDSLIYRYTQTQILISDTISSRKVAKLPNSASSSGTSLAVPDFRKFLMMNPWLLASFFPHHSPG

SEQ ID NO: 787271 - protein, 38 aa, Homo sapiens
MSISSEQQQEQDTRENLRMLLQGTFPEHLFSNVLVLGM

SEQ ID NO: 787272 - protein, 67 aa, Homo sapiens
TILRVPTWPLFTGLRQSDVTSLTFAGLAVARCRILKGSHHQLSCEADSHHQETPKWGELGSWLTQVL

SEQ ID NO: 787273 - protein, 160 aa, Homo sapiens
MCLKRQGSGCMRSRLSEEDEYGRDKEDFPVIEERLPSQGLWFWSSSSRVVFPVSGSTLNIGRTSEWWPKVPRLPALPKLPFNQLGEEGEGAEAVGFSVVIQGEPMFYNNIRGTSLCLGPVSYLRTMAQLPVGRGKRNPCESLRLNFSPTQQDGSSELKSS

SEQ ID NO: 787274 - protein, 257 aa, Homo sapiens
MYMLYMCDLHIYARAGISAYLHAVHFSVTVPRKGGSLILCFLLLLTWAFAHSDVQLCNSKPAVLQLLCFPYSLNKAGLQISVEFCEHAGLRKVRRRALVERLLELAVCRGSGRVAERVASGFQRCLVDLPAEGPQTLCLPRVHGPSLSLSLSQFWARAPHGSGPAGTVFSQDAPSPRPGSSMTPHADSNRGFEPLPAGVPRMVQAEARALLVAPCGPRRSVSFLALQRGVKHKAPVQAAQSSDGPLLKDLLRRPRRS

SEQ ID NO: 787275 - protein, 121 aa, Homo sapiens
DAAKFVIQAPGCLALAAPHSPALPLPHCSRPHQPLGPRSLGCWEGGLRGLHWEAQLQASPHILALSGWWGDKERASLGLRMKEDFSPSGLTLRWALPGAGDRCPLHPLHGHRNTTFHLQPC

SEQ ID NO: 787276 - protein, 116 aa, Homo sapiens
RYGGGRKGWNTASFSGWGVSPSHGRKEQSHIKQSRAEALSRNPLPQSHPQPWAQIVGPGLSSAGHSHPGARRACVGVSSPGWGALRADTKSSAPSYLLHHSVGRHYPLPITARRLS

SEQ ID NO: 787277 - protein, 79 aa, Homo sapiens
MGALEDPLSPHWDGIRKVWQRRKCSVKNGILTIYMPHALAELPVACWPLCMTLNASQKEMLNCSNAPKASFSEEPSVLL

SEQ ID NO: 787278 - protein, 124 aa, Homo sapiens
ELTEMCTSPVTFQDSRQVSTENRRAKTLSHSEFSQEKPSPATDELILQTYMETTYHACESAPTTNSQVHGCEFRIMERLSKREHERNTFKMTKIRRAQWLMPLIPALWEAEAGGFLELRSSRPA

SEQ ID NO: 787279 - protein, 104 aa, Homo sapiens [sequence omitted]

SEQ ID NO: 787280 - protein, 36 aa, Homo sapiens
MTAQRGGCNTSLSPETQSFAPYKNLSFMTSQHLVLA

SEQ ID NO: 787281 - protein, 110 aa, Homo sapiens
WGQGLTLSPRLECSGVIITHCSLDLLGSKDPPASAQEFETSLGDTVRPCQEKKRKKKRKEKRERKKRRKEGRKKGRKEKQNKKKGKKEKKEGKEGRKERERERKEGKERK

SEQ ID NO: 787282 - protein, 129 aa, Homo sapiens
WTQELALPPAVPTPAHLQPRWPPATQLSLHLAMLTPTQAAGALFCGLGQPPHSFQGSSSGPQPNVASPRDTSPNHSSKVDPSPLQVTSPCFVCSMARRGNVFSCLPLVSLCVNINPVTERSLSARTGTQ

SEQ ID NO: 787283 - protein, 74 aa, Homo sapiens
LDSAATPNPGPGKNHPRLRGSCQSGGHSPTPPAQGFFPAALIMKSTCTQVVSGNFLMKVSATVVCRWLSSDCSC

SEQ ID NO: 787284 - protein, 250 aa, Homo sapiens
RLSRELLDEKGPEVLQDSLDRCYSTPSGCLELCDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 787285 - protein, 121 aa, Homo sapiens
FIVSMVVTIWYVFPVAHTVCPFPCLVLPSGALVRQECGFISCKANMWIYIWVLYSMASTPRVITFKNAIQISIKHLQPRERLMALESLFIGLFCVFLRYGLCLSSRQKWSGLVIIHCSHEL

SEQ ID NO: 787286 - protein, 147 aa, Homo sapiens
DGVPFSVHVARSYTVLTKSLNLDHFTKEGMNLSILQAQFKKQRQKSTPANLYGVLIIDLACQGPSEWSWGGCGRGVKSQPSGGGHPRSPLSTIRALADPRACQEKQMGHGKSEGPLGCPDCPRSPHFCIFVHFVQVALNVVPSSWEL

SEQ ID NO: 787287 - protein, 102 aa, Homo sapiens
FCLFDSIAETLKAFYISLSVSLISRGCDCFLFILSISQKMFPFISCIMFLISLTWTSPFSGASLISLIIGLLNSFSGNSEILSGKDTLFNKWCWDNCKPHAK

SEQ ID NO: 787288 - protein, 48 aa, Homo sapiens
YKKLISPATYAKQFYLCPLLGAGRIFNSILCARAKAAALHNSRGRHSN

SEQ ID NO: 787289 - protein, 113 aa, Homo sapiens
MILWPGFKKPTYQSELKNIERICLLLKDRKKVEYSQAMFMGNTREDPRMALKASPCFHECHSRNYMSHLVCHMYFQNNTHPLLCVYLIELLFLPTRKSLTKIAMLKTSTEFVK

SEQ ID NO: 787290 - protein, 119 aa, Homo sapiens
RLSLALSPRLECSGTISAHCNLRLPDSSDSPASASRVPGIIGACRNSWLIFVLLVETGFHHVGQAGLELLTSSDPSTSASQSGGITEVSHSALPLSYLILDKNPCNWIHQHTCLSFAIL

SEQ ID NO: 787291 - protein, 386 aa, Homo sapiens
VERHKIILKCIWKAIPKKKSRGIALPDVENRTATAQRYTAPGRQPVLLQRGGDKAGSSSLPSRGHPMAPGHGAAAVLMARGNVGTGFPHPTVLCVSPEPGDFTHLTSLVFSAMPSVQTRLERCVGVPRVTQLPGGQAEVKKLVLVGAKAPDVGSSATRPAQAGGVRGEALGPAVLKSGLSRLSGRSVEGVCWWPGGGGRLTTCHFPAVPRPRRGSSPRSGPSCRTPHPHGPWFPLSVPPQMGSQHNFPRGLLFLSPHTALLGSGACSTPRTGGLGFREAGAWSCVQLGAWRLQIRAWNIHASPSPAAAASHLEQGGASPRKASGSRGVSENAGRSALTMAADATAPASVPRPLSSLVKSVLGKERSKTDVGLALWGQGTGRNPTWG

SEQ ID NO: 787292 - protein, 103 aa, Homo sapiens
SVPLESMCRNVNLPSAAVEFCGEPPEYSLLAVVILLEVNHVYLHSLTSLLGDSVSLGTLPKPTSRGKSESWAAVTPCRHGQPPRRHVRVAGALEHLDLACFHA

SEQ ID NO: 787293 - protein, 103 aa, Homo sapiens
FSHQDSLACFSLYAGRTGPSCLSPAVRPVGQVEPTGTLPGEQRASPGCRPGNPCFGQALSHTCLGSREGWFPEKMKPLARQPWLSGLECMGNGKSGPNPQCFS

SEQ ID NO: 787294 - protein, 143 aa, Homo sapiens
GVVPLLEKSCLRIQVWGAGEDVQFSSKRARQERVQDKPEGQDKPRVHRGLSWGGREGQKTPHLLCLRLQLGQGPQQPVVRRTLEGMAWGRGAAHSTQRGLHVPRGLHICAHACVLSGKLCSPAKITILWREDVAYCQEQILLD

SEQ ID NO: 787295 - protein, 138 aa, Homo sapiens
NSWLAGPGQWLDKVCWSLGHRKNLCLRGFIENYHFLCHYLLFIILCDLLVFDSLCIFDSFVILPFDLALVFTLISSVSSTPQCRLPAPLPGLPQCPHLHPCLQSCSLLLPDSPPSMSTCFGTLPFPSCSELLLCISSA

SEQ ID NO: 787296 - protein, 49 aa, Homo sapiens
SNTTFTTSSTTITTTTSVTSTTSTTSNTTFTTSSTTITTTTSVTSTTST

SEQ ID NO: 787297 - protein, 55 aa, Homo sapiens
MCRNLITFLRETFLNRYVPFDAAVDFHRWIAMAAVVLAILHSAATQSMSTSSQSA

SEQ ID NO: 787298 - protein, 101 aa, Homo sapiens
LQSFLPGCEACSECWNSSTWPLFFVLREQKGNVQSNLWCRPSMAENSSTPISGLAMKECRLLHKKSIFQTYLSETCVQIPALSIMRMALNKHSFAELFPWL

SEQ ID NO: 787299 - protein, 48 aa, Homo sapiens
CSPGGSRNPISYGVHFKEKGSLAEPAVRGELHVTKFLLPRHCPGGNGV

SEQ ID NO: 787300 - protein, 185 aa, Homo sapiens
MQDPRHPQGLPLSPGLPKRQRQDRTIYNWKQQEVLENHFKEEQYPDYDTRQELAEMLNLREYQVQVWFKNRRAKRSRERWFQKQLQQLQKHPQQQHPQQQHPQQQLQQQQPQQQPQQQQPQQQPQQQQPQQQQPTSSPSSSSSSSSSSPSSSNSSSSSSSSSPSSSSSSSSSSPSSSSSSPSSSS

SEQ ID NO: 787301 - protein, 185 aa, Homo sapiens; identical to SEQ ID NO: 787300

SEQ ID NO: 787302 - protein, 185 aa, Homo sapiens
MQDPRHPQGLPLSPGLPKRQRQDRTIYNWKQQEVLENHFKEEQYPDYDTRQELAEMLNLREYQVQVWFKNRRAKRSRERWFQKQLQQLQKHPQQQHPQQQHPQQQLQQQQPQQQPSSSSPSSSHSSSSPSSSSSTSSPSSSSSSSSSSPSSSNSSSSSSSSSPSSSSSSSSSSPSSSSSSPSSSS

SEQ ID NO: 787303 - protein, 129 aa, Homo sapiens
LPILIFKVCLLLFSSSLLLFKLLLTLDQVSIKASFLLDSSYYNSCVSEPLCPLCTLGAFIYTDVCVPQSSKDYTDVEPRLRTAMLVGLFSIKQSRNLQQCFWFLVYLFNCKKPLKRYLVTKNTNNNKIK

SEQ ID NO: 787304 - protein, 34 aa, Homo sapiens
RRGPPSFRPQNDSSTDSLYCTPGKAADIQCQPVK

SEQ ID NO: 787305 - protein, 64 aa, Homo sapiens
RYHSGRVRHVNEEAREMLQFQLPSDCNITGHPACPPAWWVILAWILHNGDHTFHLILSEFSRPL

SEQ ID NO: 787306 - protein, 117 aa, Homo sapiens
STHIHIWHRPNNSHCIIRGFYSPLSRNLSSLFAGQKDPISLRCGSSEYALPISVYTYVQGIKGRHGLFQNALKNCLNLSPSLNLPISLTGTIIFTTITETPEGLWVVLFCSLTYPST

SEQ ID NO: 787307 - protein, 122 aa, Homo sapiens
KNEFHPPSCAASLLNVSCLAQHLLPIRAVLGLGLLDEGIKRGLSAEVPPIYGWRSLWGGAVLHTSGCWGVSLGSTHQRPGAATSVMKSRNVSIHNQVFLQGGRAKFSPLVNHCDRQTTDRER

SEQ ID NO: 787308 - protein, 40 aa, Homo sapiens
KTFARNSVLVIHKAVHTAEKPYKCNECGKVFKQRATLAGH

SEQ ID NO: 787309 - protein, 114 aa, Homo sapiens
HSLPQRVLSALLAHGFIVTVTSKKAAGQIMLDSDVATNSAHTPTSTITLFCNFKPLWLRSVPLWAHLSVHVWSYQMAQHRVTIPNRPQSISKEGGLTSTLKLADGRQPRHTNTN

SEQ ID NO: 787310 - protein, 129 aa, Homo sapiens
TVFHRTGPWCQKGWGPLGYIITCICQNSWNCTPKRVNFTVYKLCLNHSGLEKQNRPGILAHACNPSTLGGQSRRNTRSGVRDQPGQHGETPSLLKLQKISWAWWHARVVSAAWGAEAGELLEPGRQRLQ

SEQ ID NO: 787311 - protein, 80 aa, Homo sapiens
MFTRESHYNTDYFGGYDISELNIQLDETQPKARGSRPLCYTCSNWHSCELHVELWEERDPLEAYLELCRKKRSHQHKKGL

SEQ ID NO: 787312 - protein, 111 aa, Homo sapiens
RQGLALSLRLECNGMTMAHHSLNLPDSNDPPTVASQVARTTGACYHTKLISFLKKVFVEMESPYVAQAGLELLGSSDPPALASQTAGIIGVSHCTQPHAVIAINCFSQMLI

SEQ ID NO: 787313 - protein, 232 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVNKKKAKG

SEQ ID NO: 787314 - protein, 232 aa, Homo sapiens; identical to SEQ ID NO: 787313

SEQ ID NO: 787315 - protein, 203 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTNARSWDKQSHWYG

SEQ ID NO: 787316 - protein, 141 aa, Homo sapiens
FGRTPSNADPGPLTDLRLQSFLGGAGVPQRSLGWSRDGCPREGAVGPSILLCPPRPLAPAQSCPSPALTIFVPTLALPLPSVLVCHWSPVLWGLCTAGCLPLLSPLPLPSCLLCPVSPCFSSPPSFSPPPHSRAWKSQTDL

SEQ ID NO: 787317 - protein, 69 aa, Homo sapiens
DSTDISSSRGTSPGSVMWPYNKPALCYGVCTHVSALDKSVFLPLLQCFSGNDVTLGLKEKKQTPLVGDY

SEQ ID NO: 787318 - protein, 137 aa, Homo sapiens
TPVKMYILYPRGGESPTSREKCFLPFIVNTLAWIDLATLQSESHKAFKKVRHRMGVFTSPGTCLGLWPDQRWGSDRTERGPGARSIPRRGRRVICCLRYLAKDQPCPVSFPLGTGSTCSLPETPWGLWPLSGLLQRP

SEQ ID NO: 787319 - protein, 32 aa, Homo sapiens
SATHRLTEELSDAGPFLPPLIEFCNTENPVHS

SEQ ID NO: 787320 - protein, 583 aa, Homo sapiens
LPDWRLVFLVKNFPVGQRVLVDSSFGQPTTQGEARREEATRQGELPLVKEVLLVALGSRQSRPYLLVHVDQELLIYEAFPHDSQLRPGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWFATLDGGIGLLLPMQEKTYRRVLMLQNALTNHAATTTLVLTFLP

SEQ ID NO: 787321 - protein, 448 aa, Homo sapiens
PPPRNSPVPLTTEPPPQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWFATLDGGIGLLLPMQEKTYRRVLMLQNALTNHAATTSRAQPPAFGMLDVGPTFRMRVAVLDGSCHRYCTEHHERRYKNGQQIIWNVK

SEQ ID NO: 787322 - protein, 626 aa, Homo sapiens
LPDWRLVFLVKNFPVGQRVLVDSSFGQPTTQGEARREEATRQGELPLVKEVLLVALGSRQSRPYLLVHVDQELLIYEAFPHDSQLRPGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWFATLDGGIGLLLPMQEKTYRRVLMLQNALTNHAATTSRAQPPAFGMLDVGPTFRMRVAVLDGSCHRSCTEHHERRYKNGQQIIWNVK

SEQ ID NO: 787323 - protein, 504 aa, Homo sapiens
PAPAASPALASPHAHLIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRGATEGLSKKSVVWENKHITWFATLDGGIGLLLPMQEKTYRRVLMLQNALTNHAATTSRAQPPAFGMLDVGPTFRMRVAVLDGSCHRYCTEHHERRYKNGQQIIWNVK

SEQ ID NO: 787324 - protein, 128 aa, Homo sapiens
GRAAAPAGREACVAMGSPAAPEGALGYVREFTRHSSDVLGNLNELRLRGILTDVTLLVGGQPLRAHKAVLIACSGFFYSIFRGRAGVGVDVLSLPGGPEARGFAPLLDFMYTSRLRLSPATAPAVLAA

SEQ ID NO: 787325 - protein, 205 aa, Homo sapiens
GRAAAPAGREACVAMGSPAAPEGALGYVREFTRHSSDVLGNLNELRLRGILTDVTLLVGGQPLRAHKAVLIACRFEGGAWGGAKWERGGTTGPLRGNPKPSLSEAGGGASQNWGRGDSEEAGLFQGAGLPEAAHVSLGSPAPKGLICSLSSGFFYSIFRGRAGVGVDVLSLPGGPEARGFAPLLDFMYTSRLRLSPATAPAVLAA

SEQ ID NO: 787326 - protein, 178 aa, Homo sapiens
RERGCRRGQNEQEELGGRLRVPGLGAGSPGSSCTSEGKGKQRREGVLGLPGSRALSTASTGLCRYGFPRRPGGSAGLRPEFTRHSSDVLGNLNELRLRGILTDVTLLVGGQPLRAHKAVLIACSGFFYSIFRGRAGVGVDVLSLPGGPEARGFAPLLDFMYTSRLRLSPATAPAVLAA

SEQ ID NO: 787327 - protein, 67 aa, Homo sapiens
AAFLKAIGYLIPLMDAEYANYYTREVMLILIREFQSPDEEMKKIVLKVVKQCWAIMLSPNTPHTSIR

SEQ ID NO: 787328 - protein, 101 aa, Homo sapiens
IMVGRSAQFFLFLLNSMIIDLLLAHFFPFLFSSPTNLRSGCCLRRSRRSIPSLAASPPFAGLFGVFSGWCLHFFLSGSQFAFTVPVLPHQLPGLLLSESHR

SEQ ID NO: 787329 - protein, 135 aa, Homo sapiens
HKRLRKSKINVAIRFSQFSALRAELLLRWWVLPAAIVAPGPGCIAHLPQPCSVPVHEMEVAFSSQLCVQRPGAPGRAESIRTGGSAHSRQAPWALGGRPQGSPYLLAHQPGSTYCPVGQVRLFPQLPLWEEGPSK

SEQ ID NO: 787330 - protein, 109 aa, Homo sapiens
EISETVEKVILPPRPVLNDVSAALQKLCGEVWLSYPAGRELGPGEVNPEFPEAVQPVCSPLNPPGVISPWATMDTIVPDRKDFYSSNVVPDKTHEVGSYLAAQMSPSDQ

SEQ ID NO: 787331 - protein, 174 aa, Homo sapiens
MTVVCRALGLGRVLVGVASGLRGWPHSGLAVPVGHHTSKDMVRPAAALEVRMPLRRHSSHEGQPRALIRHENGGGGGGCGVGASSVAPQRGAAAGRRVTGEGGTEATGSSFPVPQPSPEAGAASLFCLPGTVSCYCICSFSEPPRQSLLTAEVHPGQALPSNAVATPQALPFAA

SEQ ID NO: 787332 - protein, 66 aa, Homo sapiens
KLLHSVRARFVRFVPLEWNPSGKIGMRVEVYGCSYKSDVADFDGRSSLLYRFNQKLMSTLKDVISL

SEQ ID NO: 787333 - protein, 116 aa, Homo sapiens
RAAGIRHEQLSVHLPTHVLVPTHTAHCFPASHPTTICIHLHTHTDTPHPPPKLTYVPSHMCPPMHKPPPPPTPAPSNPSPHQLTHCHPCLTHAHSHKPLPYVPPQHKHTNLPSTQT

SEQ ID NO: 787334 - protein, 255 aa, Homo sapiens
VSRCNRRGATARSSLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDLFILAMEIIWVGQARCLLLNAVLTVRAHQANSH

SEQ ID NO: 787335 - protein, 254 aa, Homo sapiens
RQLLTATATARSSLAGSRVARVRCLLSSRMIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDLFILAMEIIWVGQARCLLLNAVLTVRAHQANSH

SEQ ID NO: 787336 - protein, 104 aa, Homo sapiens
MLPHQVETFPKSSVLFLHPHVSKGFGLCQAAWYRQSMLNSGRNGRHVGSRQNFPSLPRRLPAWAYCTAGSGHCSGCCWLQEGPENVQPLLMLRWQSSSRKSLLH

SEQ ID NO: 787337 - protein, 213 aa, Homo sapiens
PFMRVLPNHLPETLPPNTITLGISISTYEFWRRGPMVLLGITLVATLCVGSNLTIAHCLSLEPEALPGFILQNLCGGSHTPMVYAFCTSLEMAPHVPCQGLSSVLCGGQTTMSCAAPGHTGAWVTRAKLWLKTEKKNSLFSSGSGRYSPMLSSRRLLSFQIYILIFLEFVIFLHGTKGKGQDSSLALFPKDMSIAWHHLLKRWFFSLLHCSGT

SEQ ID NO: 787338 - protein, 125 aa, Homo sapiens [sequence omitted]

SEQ ID NO: 787339 - protein, 36 aa, Homo sapiens
MEFNTLLGEFLKSGSGHSCGEESDRPRRFLAGKCFR

SEQ ID NO: 787340 - protein, 60 aa, Homo sapiens
QCGGQGQRRKPGLLSQKRRGKRVLQSRKNRIKTQHDRREALNLHQREGPWAVSQLGYCGG

SEQ ID NO: 787341 - protein, 185 aa, Homo sapiens
MRTLYIQQLKSKKKEKEMADQTCIEEFVIHALAFCESLYDPYRNWRHRISGRILSTVEKSRQKYKPASLTVEFVPFFYQCFQESEHLKESLKCCLLHLFGAIVAGGQRNALQAISPATMEVLMRVLADCDSWEDGDPEEVGRKAELTLKCLTEVVHILLSSNSDQRQVETSTILENYFKLLNSDH

SEQ ID NO: 787342 - protein, 218 aa, Homo sapiens
MVLMFQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAGATLSLANSDVSLLNY

SEQ ID NO: 787343 - protein, 141 aa, Homo sapiens
MSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAGATLSLANSDVSLLNY

SEQ ID NO: 787344 - protein, 124 aa, Homo sapiens
WETGDIQGNEALVLPHHCAGGGVGTEVGLAGRGLQHRGRAWKGKPGARAAPRRELMETWRGGGRRVEEEPVELRPRLNTLPREECSTQRDGACRGPGSETTWLLGVTAGNSRMSLSGFWFLHLV

SEQ ID NO: 787345 - protein, 45 aa, Homo sapiens
MWLVDPGACARSVLSSFGLCLEQKQELACAVLRSLHGSESQRTQE

SEQ ID NO: 787346 - protein, 308 aa, Homo sapiens
RRLVLSRPPSPPTYCPQELRRRSGEHRGEEMGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRASLGAIVKEASQRGKVSLFRSILLGPTRFTELTVNRLEERTHNHRHRTHADPNPQRRQPTGMNIPTLQLKSDLRKTSLLNHMAATGAPGGGQRPGKEPGTTSRHGGRRGSKHTRQLEGPDAKPTQGPQPDTQPQPQRGGAPK

SEQ ID NO: 787347 - protein, 229 aa, Homo sapiens
RRLVLSRPPSPPTYCPQELRRRSGEHRGEEMGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLVGRTNRSRSRRATSARQASPTTGPPLGPREAGSGLAKSLGPPPDTAGDVEASTQDSWMARTPSPPKARSPTHSPNRREGEPR

SEQ ID NO: 787348 - protein, 225 aa, Homo sapiens
RRLVLSRPPSPPTYCPQELRRRSGEHRGEEMGGRRGPNRTSYCRNPLCEPGSSGGSSGSHTSSASVTSVRSRTRSSSGTGLSSPPLATQTVVPLQHCKIPELPVQASILFELQLFFCQLIALFVHYINIYKTVWWYPPSHPPSHTSLNFHLIDFNLLMVTTIVLGRASLGAIVKEASQRGKVSLFRSILLVLTRYTELTVNRLESVPDPSCTSSGPTSFLNLLFL

SEQ ID NO: 787349 - protein, 122 aa, Homo sapiens
LWVHAVGHLKADLKQNIELRQRETRAGNGTDIPMLSRGAPITCSELVTCKCPAQDQSSQLWALKSSESGGGTCCRAAASSGRWENSKQDRQKPGKDVQWRPVPRQALGGGVGTGKLGVQVWS

SEQ ID NO: 787350 - protein, 115 aa, Homo sapiens
GLPLPPLPLPLSSEGLRSPAPPAASPCSGTASSDLGRGPEPQMFLSSHIWSRRIMIPAASQGCWEDEVSLLCDAQNRATVIMPFWLLVLLLPLHLLERQDPCLDLVVRIHRVSDP

SEQ ID NO: 787351 - protein, 48 aa, Homo sapiens
RNYRCEYHEEVPYGGDHILTQLPFHLLHIQLLRKALDLKHCGSDSPAF

SEQ ID NO: 787352 - protein, 129 aa, Homo sapiens
EIQFSKAEKPTVLASDSRWRSGSKDITQQVRGHGQGRHDKHGVLDVTISLILTAGREVSIVSILSLGQRKSIVYPSLYLSYHHLKNAVVVSRAPSAGHRGLYTCSFLNYALSSLFPHLSPLSGGLMAKD

SEQ ID NO: 787353 - protein, 69 aa, Homo sapiens
SGHSTCTRFLLLHTRALCIPHPGVPLLFWRILFQAVPETLQHSILALFLPATSLLKLYCFWQLFRLFVV

SEQ ID NO: 787354 - protein, 32 aa, Homo sapiens
MKKCKVDLRLSWALLTAVMTFMQFAVNIIKVS

SEQ ID NO: 787355 - protein, 136 aa, Homo sapiens
LDASGVTRSPGLPPFPPVEELGLLRNMMDIAGLGKGVALMETTSPLRHPEGVQEGVRIALHTRDHLSYPSSHPEGVQGGVCIALHTPPWVSSCGQGVHSTLECGERRLPGPSCSMAESELVLERTHLWVVHRLQTT

SEQ ID NO: 787356 - protein, 45 aa, Homo sapiens
SAPAGITRDRWNNSGNAEWLKEPGHAPMAQPPSSTAEDLPISSLL

SEQ ID NO: 787357 - protein, 381 aa, Homo sapiens
LQRLQEQLTKDTESMTGSPLQHLLQAKQSQVLVVVNLKEVLQRLQEQLTKDTESMTGSPLQNQTACIGVLFPSAEVALLMHPAPGAVDADSAGSDSTSLVDSELSPSEDRELKSDASSDQGPASPEKVLEESSIENQDVSQERPHSNGELQDSGPLAQQLAGKGHEAVESLQAKKLSRTQASSSPAALKPPAGRETAVNGQGELIPLKNIEGELSSAIHMTKDATKEALHATMDLTKEAVSLTKDAFSLGRDRMTSTMHKMLSLPPAKEPMAKTDEGVAAPVSGGAARLRFFSMKRTVSQQSFDGVSLDSSGPEDRISVDSDGSDSFVMLLESESGPESVPPGSLSNVSDNAGVQGSPLVNNYGQGSPAANSSVSPSGEDL

SEQ ID NO: 787358 - protein, 85 aa, Homo sapiens [sequence omitted]

SEQ ID NO: 787359 - protein, 108 aa, Homo sapiens
MCVCVLNFPGMAGQTPGIYHRQQNRFTMMYACCKGRDRILLYHPAGVQWHHCSLLQPQTPGSRDPSASASWLTRTIGLQELVSKAGFSIGAGCQSRSPMACGLQCSSI

SEQ ID NO: 787360 - protein, 319 aa, Homo sapiens
QRVPGLRQQRGRRRAEAEVTKAAAAAAVSLTVAETKAAAADGERPGPGPLLVGCGRAAVGPARLPPPAAPPPAPPPGRRGGPARTQTAAAAAAGGVGGGWRRHRPGLWGGMSRDCPFEVRGSNGAFYKGFVKDVHENSVTIFFENNWQSERQIPFGDVRLPPPADYNKEITEGDEVEVYSRANEQEPCGWWLARVRMMKGDFYVIEYAACDATYNSSSISSVLKDPDSNPYSLLDTSEPEPPVDSEPGEPPPASARRRRPADATDEDRTVMDGGLESDGPNMTENGLEDESRPQRRNRSRRRVNRGNRTDGSISGDRSQ

SEQ ID NO: 787361 - protein, 248 aa, Homo sapiens
QRVPGLRQQRGRRRAEAEVTKAAAAAAVSLTVAETKAAAADGERPGPGPLLVGCGRAAVGPARLPPPAAPPPAPPPGRRGGPARTQTAAAAAAGGVGGGWRRHRPGLWGGMSRDCPFEVRGSNGAFYKGFVKDVHENSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDL

SEQ ID NO: 787362 - protein, 68 aa, Homo sapiens
TTLQTTRMWLSLAVPMLPPAAFRASTTTRPIWMIATLVVELSLSILLMGLWEPPCMSCFLGFLDFNIP

SEQ ID NO: 787363 - protein, 130 aa, Homo sapiens
MFTTWPFTEKYLPVPAVEGYIASSFQSNLLPGNVNSLLVLVICYLWEPILSLLADDENSVIYHNTNLGIKLSIRHFCKISIYFRSRTKVKPSVNESCLLVQAKWDIWQQSPGVLGALLLTASSSHWAARC

SEQ ID NO: 787364 - protein, 83 aa, Homo sapiens
ESCHWTRNVTGTSRYLPFCHFPDQNQTHSQKTQRIRIWQRSRSGKNCMGPWGPSQALPGASGVLTLSTLPLSMVLPTSDFSID

SEQ ID NO: 787365 - protein, 49 aa, Homo sapiens
IPLLRKRRFQLGRSMNLRARKNRSQIVLFQKRRFQFFCSMSGRAWVSPE

SEQ ID NO: 787366 - protein, 121 aa, Homo sapiens
IFLFCCHEPPCCAALRVSRNQLPRKNDFYSYEPPSENPSPETGESVYLQLKSGAHLCSVCGCLGPKTCSRCHKAYYCSKEHQTLDWRLGHKQACAQPDHLDLTTPDHNFLFPEFEIVIETR

SEQ ID NO: 787367 - protein, 166 aa, Homo sapiens [sequence omitted]

SEQ ID NO: 787368 - protein, 57 aa, Homo sapiens
MRERCWLQQGLMFLQIWMWLESVRRVWVTGVRASREWDGVEAHAEGQGVTRDPVPAT

SEQ ID NO: 787369 - protein, 69 aa, Homo sapiens
QIIQTLDLEEIDEIEEAYTALRHMQRDSNPTVSCLTTQTFHILEAKKKLLLAKPPTSCFCRRRPQRHYF

SEQ ID NO: 787370 - protein, 115 aa, Homo sapiens
FLIMVGSFPDNECGQSLWSSKTRTSPSSLLSHSIGQSKSQGQAQSQCGRILPNSIDTQRCEKSGTSNHSDGARIQTPETSLLEVLLHSHLPSKSLISIYVKFHLAWHCERARSCC

SEQ ID NO: 787371 - protein, 106 aa, Homo sapiens
AHSKEKGPESKLPVAPFTVEYKGVRHEFLVAPPHPSSVPVGPWSEPLHINLYPLLCICYGMEFSTWTCLGNPPLQVPLSAQSISCCGASGRFSGDPSLTVCLKQTG

SEQ ID NO: 787372 - protein, 43 aa, Homo sapiens
HSPSLLLKTDSGFPNKVICKPCHGPTEEINSDSRLDKVVHACN

SEQ ID NO: 787373 - protein, 162 aa, Homo sapiens
MSCLAGWRAASSSDSLALAPLTASSSGCSASVMAASREALWPLRHSVSAWSPLMFQFISEVSVFVCCTSSQCLPASACSFSYLIWYMLSASARLRLAISYCALTSAMMLSVSMERLLSMDSTTDVAEIWDCSSRIFSSYSRLRKLISSVSPSRPDSSSNLFM

SEQ ID NO: 787374 - protein, 162 aa, Homo sapiens; identical to SEQ ID NO: 787373

SEQ ID NO: 787375 - protein, 81 aa, Homo sapiens
MGRRKKGTSGTPEKAGALQPETGYNETRLVSRERPGTRCRNMGACMDYSSRYPPIRPPRGGASHANTGDELQQHVTENKQP

SEQ ID NO: 787376 - protein, 112 aa, Homo sapiens
GGAAAEPAARRPISSVRTGSRGSRPSRGRARGAGSPPAVPRSSAGPEPAPPAAGRLAARAARPGKRGRGLHGQRPRPAAEPSRSRAALGARIYTALLWDTPPLDLKDSPRQH

SEQ ID NO: 787377 - protein, 112 aa, Homo sapiens; identical to SEQ ID NO: 787376

SEQ ID NO: 787378 - protein, 112 aa, Homo sapiens; identical to SEQ ID NO: 787376

SEQ ID NO: 787379 - protein, 117 aa, Homo sapiens
LSEMALVNSMYQYSLIAFLEVFRLSLKKSLPDSILMKRLRNIMDTLTFSIYNHGCTGLFERHKLLFSFNMTIKIEQAEGRVPQEELDFFLKGNISLEKSKRKKPCAWLSDQGWEDII

SEQ ID NO: 787380 - protein, 142 aa, Homo sapiens
LTPHAADSRICPFPQILCQKMAHMKIAIDWILMSQPNIPVRLVPKSKPKFPAIIIPGKTHCFDISYCRLFDLPLYVSVGKICTVSKSCNFSCPSLYYHWHLSSSVWLRFNYDRDTFAFSLLLRSPRAWLALAPPEGTDVLSS

SEQ ID NO: 787381 - protein, 66 aa, Homo sapiens
MPVPLSTLVLNEGGALAEGFPTLLAFVGLLASVGLAVLNEVGALAEGLPALIAFVWFLPSVDPLVS

SEQ ID NO: 787382 - protein, 110 aa, Homo sapiens
SGFATPHIWNSPTVSFVKTVPIFQGLDSNAISLFSFFLKRSLALLPRLECSGAILAHCNLNLLGSSDPPTSVSSVACSTTPGCFLYFLVEVEFHHVAQAGLEPLSSRALI

SEQ ID NO: 787383 - protein, 113 aa, Homo sapiens
MTLICPPRGIQLDSNRRLQYATRNPSQGGLCRPRIPGLTSPPRLLLWSPKGMGWGLGALNAPHDTMAPFSSRISMPDPLRVKGSGITLGGFHMHPWAKPTCPCRGSLHSWIGY

SEQ ID NO: 787384 - protein, 253 aa, Homo sapiens
SHVGDEGRYQCVAFSPAGQQARDFQLRVHAPPTIWGSNETGEVAVMEDHLVQLLCEARGVPTPNITWFKDGALLPTSTKVVYTRGGRQLQLGRAQSSDAGVYTCKASNAVGAAEKATRLDVYVPPTIEGAGGRPYVVKAVAGRPVALECVARGHPSPTLSWHHEGLPVAESNESRLETDGSVLRLESPGEASSGLYSCVASSPAGEAVLQYSVEVQVPPQLLVAEGLGQVTTIVGQPLELPCQASGSPVPTIQ

SEQ ID NO: 787385 - protein, 132 aa, Homo sapiens
YPLSAQYTLTTNHTTLHSEAQVIEVVKSACGPFPNPLEEGISFDIYSTFIEPPTILDTEMKRLDQEQGPEESQPETDTSDMDPLVGFTIEDVKSVLDQVTDDILIGIQTEINEKLQIQEEAFNARIEKLKKA

SEQ ID NO: 787386 - protein, 312 aa, Homo sapiens
RGAASLGRDCGDVAGDDSLGADPGRPTPAGTTPESERDTEFQEHEKILSPDFLSVAQITDLLMEDIDGVQEKLRIFLNFKNLETCLKDAILLDYYVSGFLWARGMDFSIIQYSKFMTLLAMSLQNLKTLHMSLEESIKWLGEVMAEIGPTHSQKSEDWNIFDVKQANAIIDYLKISLFQHYKLYEFMFYSAREEIVIGTEQVIEVVKSACGPFPNPLEEGISFDIYSTFIEPPTILDTEMKRLDQEQGPEESQPETDTSDMDPLVGFTIEDVKSVLDQVTDDILIGIQTEINEKLQIQEEAFNARIEKLKKA

SEQ ID NO: 787387 - protein, 236 aa, Homo sapiens
EGQRLSAEIAAMSQGTTPWGPTPAGRPRREPRPNRRKLRIFLNFKNLETCLKDAILLDYYVSGFLWARGMDFSIIQYSKFMTLLAMSLQNLKTLHMSLEESIKWLGEVMAEIGPTHSQKSEDWNIFDVKQANAIIDYLKISLFQHYKLYEFMFYSAREEIVIGTERLDQEQGPEESQPETDTSDMDPLVGFTIEDVKSVLDQVTDDILIGIQTEINEKLQIQEEAFNARIEKLKKA

SEQ ID NO: 787388 - protein, 80 aa, Homo sapiens
EGQRLSAEIAAMSQGTTPWGPTPAGRPRREPRPNRSRPFPFPVPVPVPETSERSFPVRGVCGQAKSGLRRGAARLAPAEN

SEQ ID NO: 787389 - protein, 221 aa, Homo sapiens
TRGSVSRPRLRRCRRGRLPGGRPRQADPGGNHARIGALHMSLEESIKWLGEVMAEIGPTHSQKSEDWNIFDVKQANAIIDYLKISLFQHYKLYEFMFYSAREEIVIGTEQVIEVVKSACGPFPNPLEEGISFDIYSTFIEPPTILDTEMKRLDQEQGPEESQPETDTSDMDPLVGFTIEDVKSVLDQVTDDILIGIQTEINEKLQIQEEAFNARIEKLKKA

SEQ ID NO: 787390 - protein, 177 aa, Homo sapiens
MRWGHHLPRASWGSGFRRALQRPDDRIPFLIHWSWPLQGERPFGPPRAFIRHHGSSVDSAPPPGRHGRLFPSASATEAIHAVHLSGTWLSGSAWLPGRSASLANFALDTVHVDPCDPAAEVPPDELTSPIRCELGTGCIMAPRGLVVPLIGSLFYTSLTRIALLAGPGCRHAVLFGP

SEQ ID NO: 787391 - protein, 83 aa, Homo sapiens
GAQPVRGLTLTVCLTLLSVPRCHWPGYHWTLGFHCLRLQMNLVCAQCLSLWSCLLTAGGGIHVFLLDLTLPVPGMMQPVHQRK

SEQ ID NO: 787392 - protein, 129 aa, Homo sapiens
EASGLRDSESSGQACVAGEERRTPVPHPQPLFLSTSASPGRGSDVGGGRREGPRPGCGGDGCYGGFSGNQVKAARRWGQGGFHYENWKQTQPLPASADISTPTFHGISHALGCFQGFTCSHSLNFPPAM

SEQ ID NO: 787393 - protein, 125 aa, Homo sapiens
SVCRWLHLSPNIKFNYCSTLACFFFQQTQNDFISLWNSGFLFEFIKSWVKNVWDANDAAVAKDYDVFFSLGSGLVRTMSCLGFALDLDIRISCVTLSKFITSLSFTVFICKIKEVGEEIFNYFLS

SEQ ID NO: 787394 - protein, 203 aa, Homo sapiens
PFAGGGERGEHAMKASGTLREYKVVGRCLPTPKCHTPPLYRMRIFGRYYHYVLLLERARLLALSYVVLLRSTDEERLPCETETSCAWQGAGGKDESSSPLRVKNFGILLRYDSRSGTHNMYREYRDLTTAGAVTQCYRDMGARHRARAHSIQIMKVEEIAASKCRRPAVKQFHDSKIKFPLPHRVLRRQHKPRFTTKRPNTFF

SEQ ID NO: 787395 - protein, 188 aa, Homo sapiens
PFAGGGERGEHAMKASGTLREYKVVGRCLPTPKCHTPPLYRMRIFAPNHVVAKSRFWYFVSQLKKMKKSSGEIVYCGQVFEKSPLRVKNFGILLRYDSRSGTHNMYREYRDLTTAGAVTQCYRDMGARHRARAHSIQIMKVEEIAASKCRRPAVKQFHDSKIKFPLPHRVLRRQHKPRFTTKRPNTFF

SEQ ID NO: 787396 - protein, 188 aa, Homo sapiens; identical to SEQ ID NO: 787395

SEQ ID NO: 787397 - protein, 176 aa, Homo sapiens
MKASGTLREYKVVGRCLPTPKCHTPPLYRMRIFAPNHVVAKSRFWYFVSQLKKMKKSSGEIVYCGQVFEKSPLRVKNFGILLRYDSRSGTHNMYREYRDLTTAGAVTQCYRDMGARHRARAHSIQIMKVEEIAASKCRRPAVKQFHDSKIKFPLPHRVLRRQHKPRFTTKRPNTFF

SEQ ID NO: 787398 - protein, 240 aa, Homo sapiens
AQDPRGEDAPPSPRPSHTDHRAPESQQHQLRGIMPLLPHPGPVPCCPCSPQTQADRDSPSDHRTHSPPQKIPGDAPRLCVSLMAVTANLQEPGGAHGKHPQLPERSFGQGHTGARLSFLVAGGWALPVRFCHTRSRFKGSKKCKQVKCPSRDEQNTARPGHTMEQDSAMNRNQALTPATAQMPLEESTLSKRHTDTDTACNPICVNVQDRPIQRQEGDTWVPVTGDYGDWGKWLKGTHKS

SEQ ID NO: 787399 - protein, 167 aa, Homo sapiens
SAEAEPGRRRRRRLRRGDLIGAPRGAPRSLDAALKLAGLRKSAREAREPLGSVSAGRRARTERMAVPRRTRVGGTVGRRGGSPAGDRAEPPTSSKGAGLEVGFREGEGRSVGWTTLAARTAFRATEPGTAAGPGPGPGPGPALALARLPPLFPSRCGGCGWSLGFAD

SEQ ID NO: 787400 - protein, 214 aa, Homo sapiens
MPKGKKAKGTKVAPAPAVVKKQEAKKVVNPVWKRPKNFGTGQDIQPKRDLTRFVKRPRYIRLQRQRAILYKRLKVPPAINQFTQALDRQTATQLLKLAHKYRPESRQEKKQRLLAWAKKKAAGRGDVPTKRPPVLRTGVNTVTTLVENKKAQLVVIAHNADPIKLAVFLPALCRKMGVPYCITKGKARLGRLVHRKTCTTVAFTQVNSEDKGTL

SEQ ID NO: 787401 - protein, 150 aa, Homo sapiens
KPDASPGTRPSPDLSPPATSQTQKMTTPFLPFLPTQTLHLSLTPLFLSSLTFIPSENPMALPSRHGQNPASRAKPRQAAFALPDGHGCTFPGLPAPGVATISPHPSSFLNLSQITSFFCQNPPKTLSLLSAQPGAPGAHRRGTALASPSA

SEQ ID NO: 787402 - protein, 33 aa, Homo sapiens
KGGSQERRLEKEPDGRRAEERGRQWALRRCCPR

SEQ ID NO: 787403 - protein, 142 aa, Homo sapiens
PLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAG

SEQ ID NO: 787404 - protein, 47 aa, Homo sapiens
NTHSTEFIQRKAKDLHASARMNLVNIVRMKEAITKAYSQYKLEMVAN

SEQ ID NO: 787405 - protein, 103 aa, Homo sapiens
MCLFLVSLWGVYSLGFPAVSHHLPVCPCPPLCHSASPRVPLCVTLPLLVSPSVSPCLSLRSFGLCISESLVSVSPCSFSQHDIWGGGRWKATLFRPLSFQLTA

SEQ ID NO: 787406 - protein, 73 aa, Homo sapiens
GAVNSQHGVPGAMCPASLILLVFSLVIVTGTRWTYRHPLWYTRAVRGFVSEDAAVLGCWKWNCWVRENVRVVK

SEQ ID NO: 787407 - protein, 86 aa, Homo sapiens
MPEKRPFERLPADVSPINCSLCLKPDLLDFTFEGKLEAAALGAGRRIIQHCAAIVLDIDIHHSYICTQKADCKKYMHTGIYLIRMT

SEQ ID NO: 787408 - protein, 107 aa, Homo sapiens
PTSGLFKCKSDPPPLKNSSLLLIAFRIKTQLNPVISSVVPVTHIDLSFLPWAIHLPDTRLLHMFLLFIPAISRHCFGAGDMTVNKAGKHSCHSRAHFLVVAFWLECS

SEQ ID NO: 787409 - protein, 283 aa, Homo sapiens
GGGGAGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAHRGTGIVSAPVPKKLLMMAGIDDCYTSVRGCTATLGNFAKATFDAISKTYSYLTPNLWKETVFTKVPYQESLGTCQEPTESRARTQSIVVQ

SEQ ID NO: 787410 - protein, 106 aa, Homo sapiens
MGYSVGPGSEQVLTASPRYRSSTWDPRFLGQVPGKGLCGWEDVGSRLWHPTSWKHSGHSSAVTDLSSTLGACHSSHWGRLSLSPMKSSLGAPCSGLCRVRGRAYPP

SEQ ID NO: 787411 - protein, 52 aa, Homo sapiens
ICTNPARYPRYLLSSLHRILILLIHVSFCDIQALTVPFCLPMPMCLPFRQAK

SEQ ID NO: 787412 - protein, 125 aa, Homo sapiens
AEMLDDLMEKRKKKLDSVIEFSIPDSLLIRRITGRLIHPKSGRSYHEEFNPPKEPMKDDITGEPLIRRSDDNENALKIRLQAYDTQTTPLIEYFRKREIHSAIDASQTPDVVFASTLAAFSKATS

SEQ ID NO: 787413 - protein, 77 aa, Homo sapiens
AEMLDDLMEKRKKKLDSVIEFSIPDSLLIRRITGRLIRRFESKSCSVAHTGVQWCNLGSPQPPSPGFKQFSCLSPHE

SEQ ID NO: 787414 - protein, 118 aa, Homo sapiens
MVTPAGCLGGRNQGPREIPGTAFPCSSRAGQTGQAVSGAQVSSWRERQPFGGSRGPLHILGTDGNVDTTGKLGLVPTPPRIQKETKQGALCGMKPPFLPEALLTVWWLPFVAVSLCLF

SEQ ID NO: 787415 - protein, 119 aa, Homo sapiens
GTTPRSRRSRRELEIKCLIKVLELDLEGSGEPWKMLDKGVTVSYVFEMTVEACLEGVNKSQETREGACGAGLEMVREGSCLDERSSGTVSGYTQVSSELVCSESCLQDENGKELSDEDI

SEQ ID NO: 787416 - protein, 73 aa, Homo sapiens
GTQNADLGELTLSVEATPVPPKPGRKQLQQAADGSSRQDTPSSFGQFTPQSSQGTPYTSRGSTPYSQDSAYSS

SEQ ID NO: 787417 - protein, 112 aa, Homo sapiens [sequence omitted]

SEQ ID NO: 787418 - protein, 118 aa, Homo sapiens
CSSGCHAPMAHSGHEDFRVIPVVSFLDLTVGWGCNETPVAGSGLHSLPGVMGHCLAEWLWAGPFPSQPAGSYARSSLLAPPGPCFPRYRGGADPSPLKQTRLWRPHWAHFSEGQCGWV

SEQ ID NO: 787419 - protein, 352 aa, Homo sapiens
RERGQQEPGTRERDPDKATRFRMEELRLTSTTFALTGDSAHNQAMVHWSGHNSSVILILTKLYDYNLGSITESSLWRSTDYGTTYEKLNDKVGLKTILSYLYVCPTNKRKIMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDPYVFVSDNQEGGTILSVYRRNDWLTEGSENAVPRHCVYKTDATPGAQRVPKQWTRKRKQQPLLVNHGGHLNPGLEKLHKGVGNQRPKEEKRRVHKSPGHKHNAAGAHEH

SEQ ID NO: 787420 - protein, 104 aa, Homo sapiens
VTPHPKSSETWKSDYRPPGNSETSQSGIKIHQFLRELTNWDKNGPTVQRPHNLFSDHQTAQRPRTTDTMLESPKITYAGTQARKLLRGSHPGHRFLFRDVIYWT

SEQ ID NO: 787421 - protein, 145 aa, Homo sapiens
PPQSIKLVDVWGFSATLEWTPPQDTGNTALLGYTVQKADTKSGLWFTVLEHYHRTSCIVSDLIIGNSYAFRVFAENQCGLSETAPITTDLAHIQKAGKGGTGIMSWEDLRIGRAQWLTPLIPALWEAKAGGSPEVRSSRPAWTTW

SEQ ID NO: 787422 - protein, 104 aa, Homo sapiens
MYSLKKEYTVQREDKLRARAGSMWRPLSLQDHFSVFFSPVSRKSLRAVDQVTVSVLGTTATQDDTQKKKVPFWSKENVLRNASGSVPLTSYWPGLGRCPFVTRC

SEQ ID NO: 787423 - protein, 109 aa, Homo sapiens
NISFELLHGQIHLLTQCLGNCFPLFRPVLSSGCIFEPHGGALESPRKHSDQLHQNVWGRKQGASTFSSSPGNFCLQPGLTDPWFRQHFQAGAVSVCVVVAQRANLVGIE

SEQ ID NO: 787424 - protein, 207 aa, Homo sapiens
QSRCSREAHPPSVPQWDSPSPPVPLDLQGLLSTPSSPCTVDGKKLRAQGALAAAGTCRTFPTWPCRCVDEPGRPAGPCWQVSLLATSGGFEVESGQLQVSLLRGGATYGASRVGSLPCQPSCHQTSTGLPVVASGPGLGPTMGGDSDDLSNQPRARSSPETDDGPSGGSRTCAGSPRRCVAGLALRPDRGCHHPCLQFTPGSSLESL

SEQ ID NO: 787425 - protein, 36 aa, Homo sapiens
RHKQRQEEGGQGAKDGSSERAVTRAGLESPELVLSK

SEQ ID NO: 787426 - protein, 148 aa, Homo sapiens
IFFSKLSKNYVVNFLLAYLLGRFNIVIFILGTEEEFGGLVSANLILLRNRLLDILLKLIYTSKEKTSINLQACEELVKTLGFDRIMMFMEEHLHSTTVTAAMRILVVLLSNQSILIKFKEGLSGGGWLEQTDSVLTNKIGTVLGMGLF

SEQ ID NO: 787427 - protein, 67 aa, Homo sapiens
MTHSGNKALKRDTRGPGFEAEKKGGKCSESATSQASSAHTLVQATILEAQATATASPLVSMLLPLRP

SEQ ID NO: 787428 - protein, 82 aa, Homo sapiens
LVRPDYGMRLRQQRGRCVVGDCLFQMLRCLYHWHRPVLNRRWSRLCLLKQYLFTMKLQSPEFQSLFTEGLKSLTGINAFHEN

SEQ ID NO: 787429 - protein, 109 aa, Homo sapiens
ATQHIQTIDPAQPPGPWPHLLPPPMPGGCCLHEAGLFLLRVAAAPSAAPEDSSAGIKGGLPRLPAPRMLSRQLRGGADFIPARLSLRAARGGQAGARGAGRDGGGRQRP

SEQ ID NO: 787430 - protein, 115 aa, Homo sapiens
VSRLFNGLLGCPGKIPRALGLAMCTSGRQPEWFPCPLVVWGPENMRTHCTVHRICRPIVSQEGHRPLVIFPNVACPPCRITTVTCGPGWFSQDIHLDREFREILHPPRPEEGPGI

SEQ ID NO: 787431 - protein, 107 aa, Homo sapiens
FRARGSGNSMGHVERHKLTSAHRTKQPGGHRPHIQLLGVPSLPSLTLHPHPDPPLLPGSPRLAQLSPGLGKSLFCTLAAMFAKHQTFKYHVPFFFHICIPHVLLFAC

SEQ ID NO: 787432 - protein, 74 aa, Homo sapiens
HTYWPDLPPPPNQKLYESRTMTCHSLKEWAGGRQHRIKEEAQEEKNPQGPPALTGKGKSSLLSSPATGTWNLIL

SEQ ID NO: 787433 - protein, 147 aa, Homo sapiens
QAFAMHCTVDIYEDPLRHARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 787434 - protein, 136 aa, Homo sapiens; identical to SEQ ID NO: 741065

SEQ ID NO: 787435 - protein, 136 aa, Homo sapiens; identical to SEQ ID NO: 741065

SEQ ID NO: 787436 - protein, 111 aa, Homo sapiens
KSYSYALSVACEMVLYCPLSIIIPLLYLHYCSHRSMGLKSVCTLESAGELLTITSAQISPQNKRESLGVRPGISIFKSFPGDSDVPPRARATVKAAQGVLSQQRRHQSYRC

SEQ ID NO: 787437 - protein, 79 aa, Homo sapiens
ILNEINPPPPPFLSAEREPEEMNPLTKVKLINELNEREVQLGVADKVSWHSEYKDSAWIFLGGLPYELTEGDIICVFSQ

SEQ ID NO: 787438 - protein, 322 aa, Homo sapiens
MNPLTKVKLINELNEREVQLGVADKVSWHSEYKDSAWIFLGGLPYELTEGDIICVFSQYGEIVNINLVRDKKTGKSKGFCFLCYEDQRSTILAVDNFNGIKIKGRTIRVDHVSNYRAPKDSEEIDDVTRQLQEKGCGARTPSPSLSESSEDEKPTKKHKKDKKEKKKKKKEKEKADREVQAEQPSSSSPRRKTVKEKDDTGPKKHSSKNSERAQKSEPREGQKLPKSRTAYSGGAEDLERELKKEKPKHEHKSSSRREAREEKTRIRDRGRSSDAHSSWYNGRSEGRSYRSRSRSRDKSHRHKRARRSRERESSNPSDRWRH

SEQ ID NO: 787439 - protein, 322 aa, Homo sapiens; identical to SEQ ID NO: 787438

SEQ ID NO: 787440 - protein, 67 aa, Homo sapiens
SRTIVQRHMEFHTSSIMRRTGSTDVNLEFFNMCNYATIQNANNAATFTLVIRSLMAAQKSYEKEESG

SEQ ID NO: 787441 - protein, 74 aa, Homo sapiens
PSLSLKHLLLRGGGFVPLFPGLGHHSGPMFGEPVTLRAAFGRSSCCSQARFKRGFQVQPSRCSLQGASRPVPMT

SEQ ID NO: 787442 - protein, 403 aa, Homo sapiens
GASGCARSGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSAYCVVPGVCPERYSRFPGALRLAWSSWLEWAESYLLEGSGLTRNQRAYRIGRKRGPRSRRRKCRRIEARRETFQGVRKTKMWRHPGRANEEPRGGANNQNNAKKRRSRAHSQQERNTLRDESMRTKEQERTHTHGVSRRQSN

SEQ ID NO: 787443 - protein, 394 aa, Homo sapiens
GASGCARSGPAVAAEMEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSAYCVVPGVCPKLSRFLKPEIGIDAKDWVAKNLHTGELGQQTEGNTTSTQRLVQRQEKNSRHNRAGANSAKNDKATHPRPGARKSHSQRLTPKESGSGHETPNTPTGQTRSRTNVNNQRLPEPLGLRSSAKRKD

SEQ ID NO: 787444 - protein, 66 aa, Homo sapiens
SGIKAGKPFAQNHTAVARVGIQMQDCPWPYRLLDVPTVALPSQEPLLPGETPLHILMTMTIPRVKH

SEQ ID NO: 787445 - protein, 105 aa, Homo sapiens
MPDNRVQCCSYFIAPSGHGLKPLDIEFMKRLHEKVSITPLIAKADTLTPEECQQFKKQRQGLAVLPNWPQTPELKVIFPRHAPPISRHYRHTPLPLFYFEQFFNF

SEQ ID NO: 787446 - protein, 114 aa, Homo sapiens; identical to SEQ ID NO: 758493

SEQ ID NO: 787447 - protein, 289 aa, Homo sapiens
MRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 787448 - protein, 181 aa, Homo sapiens
MDNGLVIVTGCPMFIGLVMLTALETFTFISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 787449 - protein, 107 aa, Homo sapiens
PTTHRCLSKRYTCVTSKVSTQFKTGPCLPQFPSIEEGALGGLGTCPQLGRVYPGSLIPLALSVQAFWELRARVSRWNPGRGQGAGAEEPAQKRRRQGLHARAARGTG

SEQ ID NO: 787450 - protein, 87 aa, Homo sapiens
MVRMVSVLLSLLLLLGPAVLQETRDGHYSLTYLYTGLSRSGKGTHRLQGTVFLNGHAFFHYNLRGPTVPSKTETTELLGWRLAAAAG

SEQ ID NO: 787451 - protein, 220 aa, Homo sapiens
MVRMVSVLLSLLLLLGPAVLQETRDGHYSLTYLYTGLSRSGKGTHRLQGTVFLNGHAFFHYNSEDRKAEPLGPWRHAEGVEDWEKQSQVQKAREDIFMETLNNIMEYYNDGERMCGRFLRWWLLAEESWHSTPVGRLLFPVLLGFRLVLLAASGPGVYGDEQSEFVCHTQQPGCKAACFDAFHPLSPLRFWVFQVILVAVPSVLYMGFTLYHVIWHWEES

SEQ ID NO: 787452 - protein, 177 aa, Homo sapiens
RSDSPFQAEGDMLVSESCQDNNVNIKSKFMNLSQKGTPKEGPGILQPFESYGTPSQGSKNMDYSQDSKSPGKGNGASPSNSNYSYSVLKESDAENQVPCNTNNIGNLGEEEPKFHAHEENRGHSEVNFDSSTVVKEPGLKDNMNAERKSKVGNTYILKASLEPENIKSTPGVANNGS

SEQ ID NO: 787453 - protein, 67 aa, Homo sapiens
LVVIKKVDSRRDYLTSNPGCIIYELYDLAASPSSSLDIVYFVKWANARTTLRTCSAELQSVQVVPCP

SEQ ID NO: 787454 - protein, 141 aa, Homo sapiens
WPVASGDDPKPPEEGWGFVLAAVSPLCSPQCHHPRPHCPAGAQERSPWRGTVPRKANLPTAIPTQQQGLQRLPPGASAELHVLGFSSILPYCRLSSSSCPRGQAQGPHSGRIRQVRPLLGSTLEDEMLLPVSSPPSPLEFC

SEQ ID NO: 787455 - protein, 100 aa, Homo sapiens
RGRFMHKSPSPQCPDEKGIPRVGFGGTGSRIAPSGPGSTVFMACLLRCVLCRPGGSTQRLGPSPSEEQQSLCTYKGQSEEAPGIPVPSLPRGVLCPLHAE

SEQ ID NO: 787456 - protein, 245 aa, Homo sapiens
MTTYPNSVCLSVEMSLVARVRPTPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 787457 - protein, 244 aa, Homo sapiens
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRRHWGGNVLGS

SEQ ID NO: 787458 - protein, 46 aa, Homo sapiens
MPLEPHPALLMPSICTNTDEKLAPPQSSLVLLVAGWLDPCMDCPWT

SEQ ID NO: 787459 - protein, 73 aa, Homo sapiens
MVSERLIHKQNGDLLQAAKCDSKEQGRLLRDAPSGIGSIFLSASELEDGSEEMGQDALSSSPRELLSNSEQLN

SEQ ID NO: 787460 - protein, 125 aa, Homo sapiens
VNVPKTRRTFCKKCGKHQPHKVTQYKKGKDSLYAQGKRRYDRKQSGYGGQTKPIFRKKAKTTKKIVLRLECVEPNCRSKRMLAIKRCKHFELEGRKEGRVGGREGGREEGRKEKEKEREKGRKKG

SEQ ID NO: 787461 - protein, 160 aa, Homo sapiens
MLHFNRCHHLKKITQKCFSSIHVKTDKHAQRFLSRTFALAELRKSWYSTHSLVGDKNIILMGPPGAGKTTVGRIIGQKLGCCVIDVDDDILEKTWNMSVSEKLQDVGNEQFLEEEGKAVLNFSASGSVISLTGSNPMHDASMWHLKKNGIIVYLDVPLLD

SEQ ID NO: 787462 - protein, 160 aa, Homo sapiens; identical to SEQ ID NO: 787461

SEQ ID NO: 787463 - protein, 187 aa, Homo sapiens
MASCYVRLKENLNHNQVESQWLPQLTIIHLLVMFVFPRGNQVSPTFNQIILLCTSVKPQMSMGTILTNANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHML

SEQ ID NO: 787464 - protein, 73 aa, Homo sapiens
SQPNASGLQGARPSPQVGDEDTLGCHPCSSRHFLSTHCCQQDLFLLSPLQAHTTLNPAALSGKNTGLEHKCPN

SEQ ID NO: 787465 - protein, 112 aa, Homo sapiens
RPLWSRGLRPGRLVRAYTRVQSIALPPGVVNSYNGLGARRPHPRSANPLEAVQKPLAAGPTRRGGGWDPAGAGAAWLHGLYSVYTAGGRGGRLRFLRYQSRRFGHLRAPAAG

SEQ ID NO: 787466 - protein, 231 aa, Homo sapiens
GRRTAACPTAPRGRRAAAGPAQPCQPSHRRAPGARAHQCAGPAVRLCPAARARHDALLLLGPRQQDRRAAFAPRSLRAHRMPVQTDARMQGRATPAPVAADDAAASLTSHPLGPPLEPAPRVPLCFFAFLSSCRSSLSPQFMSSCAHLPDLCDLALPWPEAASLRAFYWARLFPEPQRLLPKFTAERARGGGATGRRQRRPLGLLSQVGALALRVPRPTAVQSMARRAGQD

SEQ ID NO: 787467 - protein, 199 aa, Homo sapiens
RPPHRRLPHRTTGPPRRRRASSALPAQPPPRPRHRRAAFAPRSLRAHRMPVQTDARMQGRATPAPVAADDAAASLTSHPLGPPLEPAPRVPLCFFAFLSSCRSSLSPQFMSSCAHLPDLCDLALPWPEAASLRAFYWARLFPEPQRLLPKFTAERARGGGATGRRQRRPLGLLSQVGALALRVPRPTAVQSMARRAGQD

SEQ ID NO: 787468 - protein, 136 aa, Homo sapiens
RKYPITLRGVRRLSEPDVTATSIPPTPLLLLPSLQATSPLRPPLGLGPREGTHSTGGFARVGPRQHFLVQINRWPSLWKHRPAFPGEVTRARPLKVCRRPALAGSSPRTGPRRPGEGEPVPDQRPFRGWALTPPSG

SEQ ID NO: 787469 - protein, 120 aa, Homo sapiens
SPHRERGRFLRRLPCLLGAREETSLLEAETSKEFPNRKTSGCRPQDVAGRAAASSRERAFLSCLHRSTFICFKNVKRPGAVPHTPVTPARWEAEAGGLPETRSWRAVWATEGDPPSRQIK

SEQ ID NO: 787470 - protein, 167 aa, Homo sapiens
TLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVCARNEREECGVSARSL

SEQ ID NO: 787471 - protein, 1032 aa, Homo sapiens
RVGSGGATLNALLVAAEHLSARAGFTVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGPLLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 787472 - protein, 875 aa, Homo sapiens
RVGSGGATLNALLVAAEHLSARAGFTVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGPLLKAAFICAGIVHVHSELQLSEQLLRTFGGGFELHTWSELPHGSGLGTSSILAGTALAALQRAAGRVVGTEALIHAVLHLEQVLTTVETGVPVLAGWSRSPDLVIRRWLPKVLRFQAVAPGQTVCALMLLDRG

SEQ ID NO: 787473 - protein, 94 aa, Homo sapiens
GWLLPAILGQASAGGHWLSLKPAGGGKGRRDVTLVHNSCLRLHFPGKERLFDPMGHSLLQLLPGNRGAAGGGLWLICSGGSEGSGGGLLLLRVG

SEQ ID NO: 787474 - protein, 465 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787475 - protein, 465 aa, Homo sapiens; identical to SEQ ID NO: 787474

SEQ ID NO: 787476 - protein, 465 aa, Homo sapiens; identical to SEQ ID NO: 787474

SEQ ID NO: 787477 - protein, 465 aa, Homo sapiens; identical to SEQ ID NO: 787474

SEQ ID NO: 787478 - protein, 511 aa, Homo sapiens
GSSGRARPCPTSRQRRPRAAPLARKSRRPHRDRRGSGGEAEPTLLAMGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787479 - protein, 630 aa, Homo sapiens
MGGAVVDEGPTGVKAPDGGWGWAVLFGCFVITGFSYAFPKAVSVFFKELIQEFGIGYSDTAWISSILLAMLYGTGEGGLTPGPLSGLCWRILLGACSWAQQQGLPPAPQGTLEGSPWGQDPAGQQHALHGANPGRARSPSWPLSKRVGCIYKTVSEDRLLRAVPEKVAVPELQGPKGPSRRRSRVIMACARGACPRGAPGARGGRGGVGRGGRLQAVSSVGGGGRAGCRPGPSQLLPSPGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787480 - protein, 409 aa, Homo sapiens
KAELRKTGRWFTPRKQVSEWLGGAARQGGGTEAGNACYLFYKLDGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787481 - protein, 363 aa, Homo sapiens [sequence omitted]

SEQ ID NO: 787482 - protein, 164 aa, Homo sapiens
MFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787483 - protein, 210 aa, Homo sapiens
MRVSGFGAALGGSHHIPFPPGLGLALNFQPSLIMLNRYFSKRRPMANGLAAAGSPVFLCALSPLGQLLQDRYGWRGGFLILGGLLEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787484 - protein, 139 aa, Homo sapiens
GSSGRARPCPTSRQRRPRAAPLARKSRRPHRDRRGSGGEAEPTLLAMGGAVVDEGPTGVKAPDGGWGWAVLFGCFVITGFSYAFPKAVSVFFKAKLHKAIAIFSLLSLGSPEEEGGCPQLKHMEGREHLPAPQAQRQTG

SEQ ID NO: 787485 - protein, 97 aa, Homo sapiens
GAPLSLSKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787486 - protein, 465 aa, Homo sapiens; identical to SEQ ID NO: 787474

SEQ ID NO: 787487 - protein, 465 aa, Homo sapiens; identical to SEQ ID NO: 787474

SEQ ID NO: 787488 - protein, 465 aa, Homo sapiens; identical to SEQ ID NO: 787474

SEQ ID NO: 787489 - protein, 486 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGERCAPRQFPTPALPVRRPLCEGGDAHPSAATRSVGLRAGGGALCWTNPDSAGASGSPLGVGCSVRHSVSRQAGWLGAGPGGGAAPPGSAWAPRGSSRQPNSRLLHFGASPF

SEQ ID NO: 787490 - protein, 364 aa, Homo sapiens
MVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787491 - protein, 432 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEEVQKPATLAIYFTNWTGSGRATAGLQLPAQRIVARSVF

SEQ ID NO: 787492 - protein, 164 aa, Homo sapiens; identical to SEQ ID NO: 787482

SEQ ID NO: 787493 - protein, 122 aa, Homo sapiens
MAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 787494 - protein, 272 aa, Homo sapiens
MGGAVVDEGPTGVKAPDGGWGWAVLFGCFVITGFSYAFPKPVLPWAHMGPVPTPLECLGDSSFHPWKMEINLRVGGVLGPRRFPRSMWFCCVACVLTRTSADGLAVPTVALSSQLSLQRHSIRSRGRRCMEGAAGQVPGGRCARVASEMCQGAPTWWLDGAEVEQATLFTAVFKKQDPPAFPFSPLCLAGSVRGVVSAQGSVFAPCPPSSPAQRLGLSWTPNTHLPSWPAVACVAGSPVRGRRALSRCVVGAGDAVRCLAAACTGEIPFQLS

SEQ ID NO: 787495 - protein, 39 aa, Homo sapiens
GTLCIAVMKNVPSIVVKHGSHSTSAGSEQAPRPRLATHA

SEQ ID NO: 787496 - protein, 105 aa, Homo sapiens
MGAWVPVMAQCPAQHTRQRWLPPRSPRSSPPPAGQLPQSPRDRCLPPSDCTGGCLVPGMGLDHVFPPSSALLQVGGSPPLGCPSSGSMSLEMQRCSELEPREPPL

SEQ ID NO: 787497 - protein, 106 aa, Homo sapiens
DTEAPKEGETSSRSGLVEWEEHGAGGREAWAHIPALPPGLGQPWASPFFPMGWASHGFRLRPELQGYLAGYGTEQGRMQTFRGLELVLAVILKHVNNVYKENVGGL

SEQ ID NO: 787498 - protein, 67 aa, Homo sapiens
ERTAARGHWGAGKRVSPNTQKVTREKWFLIGIVRNRPRLKTIIPELIKGYNVNKEKNTRLRVRKAQM

SEQ ID NO: 787499 - protein, 109 aa, Homo sapiens
MVLYESLGEKYRENRRNATNAGQNLGTTLLVSAEKPRGGSGAWLELRGECGRDGELPPINQSTDCPIFIVVPTQMSFESNLRILDARLFSRSASREIRGDYCTFGSGSA

SEQ ID NO: 787500 - protein, 116 aa, Homo sapiens [sequence omitted]

SEQ ID NO: 787501 - protein, 116 aa, Homo sapiens
MQLSPASTRCSWFGCWRPSRTNLIPSDSRIERQDTYPFPSHSLQPMLNAFRFFRVSENVIMRLLVIAGHACPSACHYQSCFLLAFSFFSPPSSLFLMDTPASSPACSLSLCPPAWS

SEQ ID NO: 787502 - protein, 90 aa, Homo sapiens
ELTLEDPQSLGDLVTPVIPELWEAEVGRLFELRSSRPACEIRRDPVSLCMLVPAGGAPGRCSLGCLLQGFCEGAGQGSSSWETWNSWQLL

SEQ ID NO: 787503 - protein, 251 aa, Homo sapiens
HEERVFKHVNDRQQTLSEYQDTGNTGDSSLKGYMNNGGISVIRQNTRAGSICQELESTDRCKTIGVGISNNGKNDLKEVGYQEMKGNQKNANGINKLYEQKKYVGTDNCKKEEYSKSRHVYLGRDQENMGHFNKCKHLPDLGHSDHLKKAEKCVKSKASKGNECSGNECSLKDILTSNRHMTQKSIIKEDIHPAPSTNSKDKLSGKIEEQINSTKYCKVNEDIKPKKTEAISAKKGTAKSKDEKYSKIIPE

SEQ ID NO: 787504 - protein, 102 aa, Homo sapiens [sequence omitted]

SEQ ID NO: 787505 - protein, 42 aa, Homo sapiens
EKVPTQAFTAIQNVVIIHPTHHHHTGATILIRIVKFKAILST

SEQ ID NO: 787506 - protein, 64 aa, Homo sapiens
RCVPRPPTMMTAEREAPGGGSLGRGRKQGGLQDSFPVPLVPRADDASRVIGSSLFQPPLTRLLA

SEQ ID NO: 787507 - protein, 81 aa, Homo sapiens
SSCKPSSTSKACEELFKEHQCLGSTDIPIHIQGGAPFSAVSPQRLVLRGSQDGSHMVRPRMPFPDSAGLANFHLFSKLFLD

SEQ ID NO: 787508 - protein, 437 aa, Homo sapiens
PAPSPAMKKLWVKKRFQKTGHSRRAFGRLTHVFRSCRKQSYDSETAEDDISDVQGTQRLELRDDGAFSTPTGGSDTLVGTSLDTPPTSVTGTSEEQVSWWGSGQTVLEQEAGSGGGTRRLPGSPSSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGE

SEQ ID NO: 787509 - protein, 602 aa, Homo sapiens
MMQTDKGLVCKEGSKHNANIVIEGGPDSYWEAQVCGWTGHKQVCVCVCACVCVASGSTSKCQGYQNHWGSWNNKPKYGGPQCWAHPRYLPPHPLPQDTSGDWVPHAPSVLTALHALPHKRSDNSLSLSLSCCSYGSEVFRSCRKQSYDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGE

SEQ ID NO: 787510 - protein, 1712 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 787511 - protein, 1705 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 787512 - protein, 830 aa, Homo sapiens
MRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 787513 - protein, 840 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLGNHPALCFLTPHLALSLTHTCLCLEKLVVAPARGALSRVWRWGGASLGQRP

SEQ ID NO: 787514 - protein, 1675 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 787515 - protein, 925 aa, Homo sapiens
ETCDFLQERLMTVHHVQATSATPYAMELVWVADEAHCQARLPARRRAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 787516 - protein, 117 aa, Homo sapiens [sequence omitted]

SEQ ID NO: 787517 - protein, 66 aa, Homo sapiens
EYQVTPEPPGKAVTTPDINSNLITQEQVLVLATSEQTSGQSKQIWPGAVAYACNPSTLGGRDGQIT

SEQ ID NO: 787518 - protein, 105 aa, Homo sapiens
LNLLFLLSQKRVAEFHMELEWLPAKDIQTNVYTKNPVSLEQYLMEGSYNKVFLAKGNILAKSYTVFIDILLDTIRDEMAGCIKKAYEKIPFTEATRSSSSTHPKR

SEQ ID NO: 787519 - protein, 129 aa, Homo sapiens
LQSAGPVLGTGDSAVNKTKSLPSWSLLLRGLDYSQFCELPCCFVPLLECACPQLIFLDSVCWNFRTQRRCSDPTSITTLLFMSSLCCVLQASSSPGPGLTRLCVSSTYSSAQRITDASKCLLNEKHTSM

SEQ ID NO: 787520 - protein, 642 aa, Homo sapiens
APAATSAPTPTPAASPAPADGSKPQESVALPRRYQEGQVSASWGNLIAMVLRSHPFPRQDRPQGSVPRAVPGSPVGPSTSTHSEDRHGPSSSVGTVIGTGTGGLVEAGGQPQPRSSETNGSPSPDPPPGLRGEGTREKSLDPLPQAAMPRGPAQPPAQRPPGPAASSSARRSQPVPQLRKRSRCEIAPSSEQEVRPAASGDPQGEAPGEGGSPAGRSGALTEKQEEARKLMVFLQRPGGWGVVEGPRKPSSRALEPATAAALRRRLDLGSCLDVLAFAQQHGEPGLAQETYALMSDNLLRVLGDPCLYRRLSAADRERILSLRTGRGRAVLGVLVLPSLYQGGRSGLPRGPRGEEPPAAAPVSLPLPAHLHVFNPRENTWRPLTQVPEEAPLRGCGLCTMHNYLFLAGGIRGSGAKAVCSNEVFCYNPLTNIWSQVRPMQQARAQLKLVALDGLLYAIGGECLYSMECYDPRTDAWTPRAPLPAGTFPVAHEAVACRGDIYVTGGHLFYRLLRYSPVKDAWDECPYSASHRRSSDIVALGGFLYRFDLLRGVGAAVMRYNTVTGSWSRAASLPLPAPAPLHCTTLGNTIYCLNPQVTATFTVSGGTAQFQAKELQPFPLGSTGVLSPFILTLPPEDRLQTSL

SEQ ID NO: 787521 - protein, 37 aa, Homo sapiens
MPNLSSSKPSSQNSWKEAHCQRATYYSQSWGRRGREF

SEQ ID NO: 787522 - protein, 87 aa, Homo sapiens
WQFRHNPMANRNHSLFKALSVWAATPQHPAQCTLSRKRSELSAQRTFQKPSASAEHTTFKIFRKAQSGICKYGKKSLVKAQLDPEHV

SEQ ID NO: 787523 - protein, 42 aa, Homo sapiens
MVWRRFTAPQRAPPDIIQSTKHRAWAKANVTSGFLIDVGILE

SEQ ID NO: 787524 - protein, 104 aa, Homo sapiens
PARRFLAEQGRELGRRRAQAGARSAPASLAPPGGAPRSHRPQIASRAPARREPCAHPQLCCRRGRGSRVRVRVCLSLAASWGQQRKGGRRERQPRRTAAREAEA

SEQ ID NO: 787525 - protein, 65 aa, Homo sapiens
ALFAKSLLCRAPTQGKIQGSLHFREWSPRLGTDQLCVSFGLLAPLLVSIASWTHRDFIFSSFLAP

SEQ ID NO: 787526 - protein, 310 aa, Homo sapiens
MAQLQTRFYTDNKKYAVDDVPFSIPAASEIADLSNIINKLLKDKNEFHKHVEFDFLIKGQFLRMPLDKHMEMENISSEEVVEIEYVEKYTAPQPEQCMFHDDWISSIKGAEEWILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVESGSLKSTLTGNKSVIIVFPNSPLS

SEQ ID NO: 787527 - protein, 204 aa, Homo sapiens
MVVSGAEILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVESGSLKSTLTGNKSVIIVFPNSPLS

SEQ ID NO: 787528 - protein, 35 aa, Homo sapiens
TCNPHPSNTKLLPTPNCTNWIFFATVFSHMFFPPH

SEQ ID NO: 787529 - protein, 84 aa, Homo sapiens
RLPGWARGLFQPVLQLGLGHTAAGSQMKPAGARPQPMNQRCPKEHLGQQRDFPMEEGRPRGHVGWTSLGPSAKADLLLQVPLSS

SEQ ID NO: 787530 - protein, 200 aa, Homo sapiens
AWAATVMAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 787531 - protein, 200 aa, Homo sapiens; identical to SEQ ID NO: 787530

SEQ ID NO: 787532 - protein, 145 aa, Homo sapiens
MDGAILLILAIKRNPKSRMEELDISNVLVSEQFMKTLDGVYAVHPQLDVVFKAVQGLSPKKTIFLLTNPMKLIQSYADQHKITIVDFFKSLNPTGTMKMSVDEFQKVMIEQNKVPLNQYQVREVIKKLDEKTGMVNFSFLNTMKP

SEQ ID NO: 787533 - protein, 113 aa, Homo sapiens
QLPSSSGKISSGNSFPPQQAGSPLKRPFPAAAPAVAAAAPAPAPAPAAAPALAAAAVAAAAGGAAPSHSQKPSVPLIKASRRRPAAGRPTRFVKIAPAIQVRTGSTGLKATNV

SEQ ID NO: 787534 - protein, 102 aa, Homo sapiens
GIPQVLDPPQELFISWAHLSILIVLNISQIQFCYEILNGAAPCSVLKWLAFHYEDKPRSSGHWSDKLASHHSVLPCSHLPPSLLLEPSEFCTVRLFLQSSHG

SEQ ID NO: 787535 - protein, 41 aa, Homo sapiens
MWAGEAACRWNQQYLEKEFLKVVEHREESGKIPGTVVAGGL

SEQ ID NO: 787536 - protein, 163 aa, Homo sapiens
MLIGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEITKFLTSLELLKAL

SEQ ID NO: 787537 - protein, 318 aa, Homo sapiens
QSERQGSMSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLTWAPASFMCAPGGELQRHQLTLLSLSSGSFSATVCPNQGHHGFGLLHPMLDPSSGSLSGDSELGLESPQVLDLHHIHSVERVPGYQ

SEQ ID NO: 787538 - protein, 100 aa, Homo sapiens
MGGLGEGRTAGPIRFSSDWNRDIFYIWNPRLFLDSSGLLEFHTVFCCPPRSLPIPSMGVSFSGITPRSYDILPTPTSFPILRSSRSLLLPSASQVILAPP

SEQ ID NO: 787539 - protein, 77 aa, Homo sapiens
MGLLGSPGHVFPHCGPLVLAPSLVVAGLSAHREVAQFCFTHWGLALLYVSPERRGMVPSGGVCSVLAPLSTPHLSFP

SEQ ID NO: 787540 - protein, 328 aa, Homo sapiens
QSERQGSMSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPLPVFRLLFGNCLPQPRPPWIRAASPHAGPQQWLPYVGYSELGLESPQVLDLHHIHSVERVPGY

SEQ ID NO: 787541 - protein, 130 aa, Homo sapiens
VILLMVVCSQHLGSCQFHVCPWRRASTSSTHTPLPVFRLLSVCVGLGRAVEVRRAGPGVLTPSPTFWLLSTPARLAQKVLGEEFFSQSRPSGADPSGLCVDCFCLCGIQCYPPGTVCPHQGTMDLAASPR

SEQ ID NO: 787542 - protein, 111 aa, Homo sapiens
KKKKNLWAVACLSLPSSRGRQGRSASWFWKKPRTSYRLRLSCWFSYNAASLQSCLIFQGAEIAKLVSILTYEMKGELGRKGEGGNLIITVRCMRGNFMQAGGQNFFHLYWE

SEQ ID NO: 787543 - protein, 31 aa, Homo sapiens
MHHLKENVGPMEHAPPLHKEAVDKLRMDQDS

SEQ ID NO: 787544 - protein, 76 aa, Homo sapiens
QRMLSVDLAGSPSKNGIQPAFNAYGWAIVSQTFYAQYFHKGTHAERGEDLPVSFYACMRHSQWMWAMLEDVHRKII

SEQ ID NO: 787545 - protein, 108 aa, Homo sapiens
KVQLLPSGHLCMEPPTAVPQNRSEVTFRGAGHMYAGACCPHPLALLLFLFLRWSLALSPRLERSGVISAHRKLRLPGSRHSPASASQVAGATGTRHHTRLIFFVFLVE

SEQ ID NO: 787546 - protein, 98 aa, Homo sapiens
MVHKEQHENTSNEELQTRTVETPHTRTHTTKRTVFTHLGSEETVEREVRDPERRDRLKQGRGCGELRSRHCTPAWATRVKILLKTNKHTSTLKFHTFS

SEQ ID NO: 787547 - protein, 110 aa, Homo sapiens
MVHSALNSDRLAVSNYQAETSLEPRPPLPPSAVPGPPTRRSGPRGCLPASWGFCPFSYRLPPSCCYVSRLESDYPSSKVVGGGPGSGRPHHQLPAGTSRRRAARKMAWAA

SEQ ID NO: 787548 - protein, 104 aa, Homo sapiens
MLLQQGQGPCQPPTRHTRESPACEGATPRAGIRMKTRLHSEHGARDRTQRGRPAREAFTLQTARSTYTPTGLHDSPQVPCHLRHLPPRPLSVTPSAVHLQKAWN

SEQ ID NO: 787549 - protein, 97 aa, Homo sapiens
PGLVGKWEGACHWRALGWGLSSESLPAPRSSRRRQLGTTHAHLVSLTPPLGVPTSEPRHTVKPVFRRAQLSPPHPGSSVPPAETSPPASKQEGLRLD

SEQ ID NO: 787550 - protein, 143 aa, Homo sapiens
LSVVTIIICFTCSCCCLYKTCRRPRPVVTTTTSTTVVHAPYPQPPSVPPSYPGPSYQGYHNFLVEDGKELLGAHHAITQFYPDDEVTAIIASFSITSVQRSDNGSYICKMKINNEEIVSDPIYIEVQGLPHFTKQQQQYGSGD

SEQ ID NO: 787551 - protein, 163 aa, Homo sapiens
PPSLALVGPWSAAPQLQPQSRGALRPLPGPGILQTPINRWQSRGWLEIFRDSKSGRRSRESSRERKVTRHISRKSTVSREMKDSQVGRGAAKEEAPQTESGGEQKGFGARADRAVWYRDSKRGQPMTRRSRGRTTARGGLGSGGAKEWGQRCVTGKREFNREC

SEQ ID NO: 787552 - protein, 162 aa, Homo sapiens
KPPAEPAPLLLNVTDQILPGATPSAEGKRKRNKSVSNMEKASIEPPEEEEEERPVVNGNGVVVTPESSEHEDKSAGASGEMPSQPYPAPVYSQPEELKEQMDDTKPTKPEDNEEPDPLPDNWEMAYTEKGEVYFIDHNTKTTSWLDPRLAKKAKPPEECKEN

SEQ ID NO: 787553 - protein, 138 aa, Homo sapiens
MFSCLSSLQVHPLLLKAFCFQPLRGSSSPSSAPPQGSVSRFGALFHYHKFHQLFPALKSSILILALCFYPHPLFQKPWPVSPWVPLSVTLVSIPEPVCFLPAVTHCQPHPGGPPCHCQPASLYVTNSAHSPPASSITQ

SEQ ID NO: 787554 - protein, 106 aa, Homo sapiens
LCPNLAAAHYSDRKLPTVFCQTHYSGSHNGLRPRLESSGFPGCADGLETWPRGRDQHSLVSCISTKCCDTRNGPQNVSGQHSFVFASHFSVAVKYCGKAKVQTHVH

SEQ ID NO: 787555 - protein, 420 aa, Homo sapiens
LTSAGEYYGLSCAGCCFSAPGSGQGGKRRVNMELSAVGERVFAAEALLKRRIRKGRMEYLVKWKGWSQKYSTWEPEENILDARLLAAFEEREREMELYGPKKRGPKPKTFLLKAQAKAKAKTYEFRSDSARGIRIPYPGRSPQDLASTSRAREGLRNMGLSPPASSTSTSSTCRAEAPRDRDRDRDRDRERDRERERERERERERERERERGTSRVDDKPSSPGDSSKKRGPKPRKELPDPSQRPLGEPSAGLGEYLKGRKLDDTPSGAGKFPAGHSVIQLARRQDSDLVQCGVTSPSSAEATGKLAVDTFPARVIKHRAAFLEAKGQGALDPNGTRVRHGSGPPSSVGGLYRDMGAQGGRPSLIARIPVARILGDPEEESWSPSLTNLEKVVVTDVTSNFLTVTIKESNTDQGFFKEKR

SEQ ID NO: 787556 - protein, 364 aa, Homo sapiens [sequence omitted]

SEQ ID NO: 787557 - protein, 420 aa, Homo sapiens; identical to SEQ ID NO: 787555

SEQ ID NO: 787558 - protein, 396 aa, Homo sapiens
HWTRRRPPASRAGVSRRMSAAHVGKSGGQEGRMEYLVKWKGWSQKYSTWEPEENILDARLLAAFEEREREMELYGPKKRGPKPKTFLLKAQAKAKAKTYEFRSDSARGIRIPYPGRSPQDLASTSRAREGLRNMGLSPPASSTSTSSTCRAEAPRDRDRDRDRDRERDRERERERERERERERERERGTSRVDDKPSSPGDSSKKRGPKPRKELPDPSQRPLGEPSAGLGEYLKGRKLDDTPSGAGKFPAGHSVIQLARRQDSDLVQCGVTSPSSAEATGKLAVDTFPARVIKHRAAFLEAKGQGALDPNGTRVRHGSGPPSSVGGLYRDMGAQGGRPSLIARIPVARILGDPEEESWSPSLTNLEKVVVTDVTSNFLTVTIKESNTDQGFFKEKR

SEQ ID NO: 787559 - protein, 126 aa, Homo sapiens
TSPPPSPHLEAHSTLSIPLPAASSPLRLIILRTAAGVTSQKHRSHLLLPCSTLSQDFLFSPKVQTSHWDFQDLSSSLPVPLLTPDPAFLGPSLSQTGQALPGVGFMIKSNGAGSAYWANGLAFAVG

SEQ ID NO: 787560 - protein, 126 aa, Homo sapiens; identical to SEQ ID NO: 787559

SEQ ID NO: 787561 - protein, 120 aa, Homo sapiens
FPEHCIPNIYRKFPLLPYLLGISIWMSVISHSTCLKLDSYFPFLNLFLKSFLLSADGNSNFHLLIPQKLVSSSTSLSLLDLISSPSMSLIPSTIKIYSESDHFHPLHCCHPYLFRHLIPP

SEQ ID NO: 787562 - protein, 103 aa, Homo sapiens
HLTFLVLQSKRTSSASHFLTVADSPCSLLAWPDFRGPLCRLRCGVHFNRDLALVLSPSNLFGYSHSTPHSVFYSSFLPFLSSTFFLPIASLPPFPSSLPFELH

SEQ ID NO: 787563 - protein, 102 aa, Homo sapiens
IQMALKQVIVEHASYRCVLSENFQQLGFRASLLSEFLIQTPLERRGEGGKEGTTHQGTWYCSMCSNTWSSGGRWRFTGHMNMMRVSRIAATSPGAGLQVGAA

SEQ ID NO: 787564 - protein, 134 aa, Homo sapiens [sequence omitted]

SEQ ID NO: 787565 - protein, 118 aa, Homo sapiens
QSKTVSKKLKKLKKNKSKEGLLRLSWLDLLGDLVLPALCLTYSQQINCLFLVGQIKLFKRLQVPSSTESMGKHILPYILLETNTVGPPTADHYAYDGCICTDPCTHFFSCHYSVNNTV

SEQ ID NO: 787566 - protein, 115 aa, Homo sapiens
MFSGPSTAHGHSMDIPYYFGPDSFVEPGINAHIWSFLSPSLQISGLFKSLRGTLLEAHSMDTLVNINGVLLGHHLVDGIMAILLTILLCRRPSCLNVLGSRHLSYKSPDLAGHNG

SEQ ID NO: 787567 - protein, 111 aa, Homo sapiens
ASEDAVQGIAKEDAAQGIANEDAAQGIANEDAAQGIAKEDAAHGIANELYTTSLTRTPYKPSLTSTLYTTSLMRALYKTSPMRALYTTLLMAPTRHANVDAVHDIANEDSV

SEQ ID NO: 787568 - protein, 77 aa, Homo sapiens
DKEYAGRLVLENTRGKYVGIEDESAVVGVLVGSVPLVAIDLMVREAESGGLLEARSSRLQCTIIMPMNSHCNPAWAT

SEQ ID NO: 787569 - protein, 218 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEQRRAGCC

SEQ ID NO: 787570 - protein, 511 aa, Homo sapiens
RVRCILAPVARLGPALRRGAAHIFTSGSPLSGTMATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKLPRKWSQTQMLSNWKREEETLDTIKQYYVLCSSRDEKFQALCNLYGAITIAQAMIFCHTRKTASWLAAELSKEGHQVALLSGEMMVEQRAAVIERFREGKEKVVVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 787571 - protein, 475 aa, Homo sapiens
LVGRKAFCIYKQPAAPLSEGTRRGGAARPEEAAEEGPPAAPGSLRHSGPLGPHACPTALPEPQVTSAMSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIPGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSMPLQDELAFAEDLVLDEEGARAAGLGELGAALLKLVRAAAGPAAGARGVCATKGLALANSDSVHIPKFRSCDAAVRNMHEALVEDEPPGGPEGVLRGGGRPLVAHRRPRRRGSGANHRENEEGPDQRSRSS

SEQ ID NO: 787572 - protein, 265 aa, Homo sapiens
MLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSMPLQDELAFAEDLVLDEEGARAAGLGELGAALLKLVRAAAGPAAGARGVCATKGLALANSDSVHIPKFRSCDAAVRNMHEALVEDEPPGGPEGVLRGGGRPLVAHRRPRRRGSGANHRENEEGPDQRSRSS

SEQ ID NO: 787573 - protein, 487 aa, Homo sapiens
GGLPRAGRGRRSNFRQLPKGVRRLGAGRGAPGGGGLCDSGSIRVDLQAGPEEAPSGGPAVCLGPACWGRRAAACQVTSAMSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKKDHPGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSMPLQDELAFAEDLVLDEEGARAAGLGELGAALLKLVRAAAGPAAGARGVCATKGLALANSDSVHIPKFRSCDAAVRNMHEALVEDEPPGGPEGVLRGGGRPLVAHRRPRRRGSGANHRENEEGPDQRSRSS

SEQ ID NO: 787574 - protein, 363 aa, Homo sapiens
LVGRKAFCIYKQPAAPLSEGTRRGGAARPEEAAEEGPARGPRLTPALRAARPPCLPDRAAGAPGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSMPLQDELAFAEDLVLDEEGARAAGLGELGAALLKLVRAAAGPAAGARGVCATKGLALANSDSVHIPKFRSCDAAVRNMHEALVEDEPPGGPEGVLRGGGRPLVAHRRPRRRGSGANHRENEEGPDQRSRSS

SEQ ID NO: 787575 - protein, 97 aa, Homo sapiens
ALWEAKTGLPQGQDHKVRRSRPSELTQQHRRRHTYNTGGDTQHRQRHTTQTKIYNTAEDTHITQVKTHNTDEDTQHRRRHNTDEDTHINTGEDTQHR

SEQ ID NO: 787576 - protein, 60 aa, Homo sapiens
KEAGRVGPAPRRKFVRAGTLGQAEGDPSLPREKRVVSGAGGGQHGVWAQGWGGGGGAEVG

SEQ ID NO: 787577 - protein, 104 aa, Homo sapiens
MGMGPTLCRSHPDLPYLFVRRVSECIRLGSHHCLRCARPLVFPGLTVSPPDSACLGLFPPSLALSYPITRLWPLTSGPKGRCCHRNACGVAPSPREGLSYCTTG

SEQ ID NO: 787578 - protein, 71 aa, Homo sapiens
ESYNRETAIQDTGLPRHQPHQSQSAGNTGMSHHAQPFLVSLMMAIPPSQARIMEIIVSTDYFLLQEKLKNA

SEQ ID NO: 787579 - protein, 50 aa, Homo sapiens
MNTGNSFESSNWWGPITFHVTKLGKRETEKYNRSQKYKEQGGYCVDTRRV

SEQ ID NO: 787580 - protein, 84 aa, Homo sapiens
MPAEVVSTMKPNWRDESSRYELFISIIENLLFPPLVFPARIDDHKTQARNVLVCREQSRRHLFCCCGSRPDSGMKALDMKGTEL

SEQ ID NO: 787581 - protein, 282 aa, Homo sapiens
SPAQSERGPGARSPGAAMVEAAPPGPGPLRRTFLVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSCPTRWYWKLVPIRYRKDRVVARRAPCFPTVTSLQDLASGAALAATIHCYCPQLLRLEG

SEQ ID NO: 787582 - protein, 78 aa, Homo sapiens
CDVGRLHVGVCMWVSVPSSVSCLHVGVCTLTCLVSAQACVGVPAGLFGGRPVILEVTHVFCGCLLLAPHSVEMGLHWP

SEQ ID NO: 787583 - protein, 42 aa, Homo sapiens
ACLSVIRRIGQPPSPHHSNSHNASGVCPDLLVTTAATLIKTT

SEQ ID NO: 787584 - protein, 137 aa, Homo sapiens
AVDDLLMCLPYVDLYSLCDDSLMCLLLDDPTLCDDPRPPRALPGRPEAAQGPSRGDPRPSRALPGDPRPSRALPGDPRPSRILDSKDPLTSVLGEISFCLRVCSARGSRPGDDGSACLGRGHLFFPRRDLPSHSPIS

SEQ ID NO: 787585 - protein, 76 aa, Homo sapiens
GRPEAAQGLPGRPEAAQSPPRETRGRPGPSPGDPRPPRALPGETRGRPGPSRETRGRPGPSRETRGRPESWIPKIR

SEQ ID NO: 787586 - protein, 67 aa, Homo sapiens
TEQVMHTAGERGWERKISRLDPQLPPLGPKDCPTWHPHPQQSLATASPNNHSQSTEELTDTTDTDYS

SEQ ID NO: 787587 - protein, 76 aa, Homo sapiens
MCVFGVVVAAVAAAAAAAVAAAAAAAAAATAITTEVFKGSSESFVLRSPDPSKPHNSCFFSLFSLFFSLPDDCSQE

SEQ ID NO: 787588 - protein, 138 aa, Homo sapiens
LLEFGKTLCVRSAWSRSCHFHVARRHLPVLGGRCPELWHGGDWSPQGCCFHSVWDPQFLIELNRRIAFAFLRGILSCSLGLVEFRTPWATRWTMFPPETPRGRVGVARASMQEWDLEAWWHGVLGRLLGRVRAVEPPH

SEQ ID NO: 787589 - protein, 40 aa, Homo sapiens
LHPGSEPAELCEHTDPIQAGQSQKKGQLYFQTAAENPKYP

SEQ ID NO: 787590 - protein, 71 aa, Homo sapiens
TRDVQTKMSTPTPYKKMNWRLHTLTHMHIYTDEMFGQRQISRGHFCFFLNTGLLGGILFFPAIKKGPKVHV

SEQ ID NO: 787591 - protein, 117 aa, Homo sapiens
TGLVQVEWWKTNQRGMSIPVPWPQGLQQGSWAGKQSLCDSILASVLSLVSPARRKSLSRLYFLGILRKMMATGDASSSQGLTSPPAGLKCCHLKRSSGHFSKFRRSPRSSSGVMTLG

SEQ ID NO: 787592 - protein, 57 aa, Homo sapiens
EFEATTSDIAVGGGDRHLKHSKDWSAGSEIQKCRLQRRVERSWSVPMRGERGRWAET

SEQ ID NO: 787593 - protein, 1330 aa, Homo sapiens
QRLSIACRLRGKGTQVPADVMAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAAGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLMQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 787594 - protein, 205 aa, Homo sapiens
QRLSIACRLRGKGTQVPADVMAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINEVTPALMWLWGRGHPKVLLRVGRARDSQWGIQSWEKPLLAGAASRTKARGM

SEQ ID NO: 787595 - protein, 104 aa, Homo sapiens [sequence omitted]

SEQ ID NO: 787596 - protein, 173 aa, Homo sapiens
FILDSLDVTLYWLWVLPPLENGEFSSHRQFSTWQSSLILRWLGARLSNDFLFALSPGCGSLILKDLESLLGVTGSLDILLPTSSWLSLSLRCCPGPGQLGSPCSLPAVPLCRAQALQWCFSLDSAVDLRVVRPHISWFSLCGFFLRRAFPHILVALAGRDPSPCSAGRCAVCG

SEQ ID NO: 787597 - protein, 164 aa, Homo sapiens
LGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRYNFLLTSEMGGFGIMRVRGTHCERGRVKPTCLIFVP

SEQ ID NO: 787598 - protein, 124 aa, Homo sapiens
THGEIEECCGHSNGRAVLWLRLLPQFWVSLRVTWLGDLNPPGPGAGVCLCHPAGAGPLSHCAAVVWPPAVTVPASRTPSPSRFDIRRGAASRALGEGHSYGPERLLCCASKCSPKGRDNGLTHL

SEQ ID NO: 787599 - protein, 43 aa, Homo sapiens
RTQLTSPTAVLTYFITVWHNYQHVNSKKVLHLIPVPGIGIGCI

SEQ ID NO: 787600 - protein, 328 aa, Homo sapiens
RETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVRDTQKDVPLGPEDPKEEDGSFDYDVMRTTSPAGQSDISGRHHPSSQESDDSLVDYGAGLGEGVQSTDTHGSLPSGQLTRCQKRTTDVHPAGPSEQLRKPHVTSPTVYLPSLAYGAHPGPATTFAC

SEQ ID NO: 787601 - protein, 145 aa, Homo sapiens
FIWLTLCILCCLQILVSSPGIYFWLNSRGMKEVPYPHLHHSYPSNLNSFPHITPISFLSEDFLDKTRISHLPTTRTVLQPFTFPLAPLSNFSELQPSPPTPILPSLILSHASERPAVQKSRAAKIAGACGQAKAVHRHQLLSVFS

SEQ ID NO: 787602 - protein, 83 aa, Homo sapiens
GTHQRMKPEAPLPSARLYLPSTCTSPVWPCQRDRLPPAKTVPGSLGPDSMAFLSRSRGSVVQAPFTTLSTGSYSFEEPRGGWW

SEQ ID NO: 787603 - protein, 178 aa, Homo sapiens
MSTPPLAASGMAPGPFAGPQAQQAAREVNTASLCRIGQETVQDIVYRTMEIFQLLRNMQLPNGVTYHTGTYQDRLTKLQDNLRQLSVLFRKLRLVYDKCNENCGGMDPIPVEQLIPYVEEDGSKNDDRAGPPRFASEERREIAEVNKKLKQKNQQLKQIMDQLRNLIWDINAMLAMRN

SEQ ID NO: 787604 - protein, 153 aa, Homo sapiens
MSTPPLAASGMAPGPFAGPQAQQAAREVNTASLCRIGQETVQDIVYRTMEIFQLLRNMQLPNGVTYHTGTYQDRLTKLQDNLRQLSVLFRKLRLVYDKCNENCGGMDPIPVEQLIPYVEEDGSKNDDRAGPPRFASEERREIAEVNKVLGEAF

SEQ ID NO: 787605 - protein, 198 aa, Homo sapiens
EISRRRRKGPGRNETGHECWSEATGLLVLSSYCEFFPLPQDIAEIMSLSDTPLNVLLIRDMQDIVYRTMEIFQLLRNMQLPNGVTYHTGTYQDRLTKLQDNLRQLSVLFRKLRLVYDKCNENCGGMDPIPVEQLIPYVEEDGSKNDDRAGPPRFASEERREIAEVNKKLKQKNQQLKQIMDQLRNLIWDINAMLAMRN

SEQ ID NO: 787606 - protein, 141 aa, Homo sapiens
MSTPPLAASGMAPGPFAGPQAQQAAREVNTASLCRIGQETVQDIVYRTMEIFQLLRNMQLPNGVTYHTGTYQDRLTKLQDNLRQLSVLFRKLRLVYDKCNENCGGMDPIPVEVIFCDRGRMNIRCELVSRQLLIFFLSLLF

SEQ ID NO: 787607 - protein, 105 aa, Homo sapiens
DQRTPPFCDYGAVPKPVRKADDMVCSCSPPVDCPVSDLGSWSVSPAWLKKERGRTCEANSERFICLNSSWWKSMESRIFTRTYSKPLHLASCIHVAPSRSQFFLS

SEQ ID NO: 787608 - protein, 48 aa, Homo sapiens
MIFTLFTINVSTDMRHHRVRLVFQDSPVHGGRKLRSEQGVQVILDPVH

SEQ ID NO: 787609 - protein, 113 aa, Homo sapiens
MAWTLACVCVLGSILVLDSGMCVRAGECLDGDVVSLLHFWHSVTTQENQIENLESVLQWIETGLQSLRKKSKQNTQEFRENIFLPKNNFSFMLFLIWVNTPMEKIDRLVKSSI

SEQ ID NO: 787610 - protein, 211 aa, Homo sapiens
FSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSREVYYSRSSLKLSFTQLTRLEMVFIFCGKYTD

SEQ ID NO: 787611 - protein, 122 aa, Homo sapiens
MGESISFSDEGAAQRRRGASQRCTARWHHSQDRDLGILEPFPALALGQPWAPKALPPYWLPGEFLKKQPSSPPQPLHSSHLPPHGPQTPCEAPPPDLFPATARDEFPLSCPGWTLLGAQQSS

SEQ ID NO: 787612 - protein, 229 aa, Homo sapiens
MLRDPVSRYLSEWKHVQRGATWKTSLHMSDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 787613 - protein, 237 aa, Homo sapiens
SRNFYYITMLRDPVSRYLSEWKHVQRGATWKTSLHMSDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 787614 - protein, 1280 aa, Homo sapiens
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGAGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 787615 - protein, 362 aa, Homo sapiens
MYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 787616 - protein, 295 aa, Homo sapiens
MAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 787617 - protein, 107 aa, Homo sapiens
PPQAVSGLRSGGGALAVESWQRRPAAAGRVEKMISNPEKCRPDGGPEWALGEETKFCCVAHDGLKLLSSRDAPTSTSQGAEISGMSHWVSPCYHILRPCRNQDLLKE

SEQ ID NO: 787618 - protein, 216 aa, Homo sapiens
MNNPQTTANTRRRQKEKTDTEEANTPDEKQQQTHQTRPQRHTQQKQGEKHRRRQHTEKKNRRTQKQKRKERGRKRGRERKTNREEKVRAEEGRNRQNGRTERREGRQKAGQRRREEGDGRGGRSSEGERERAGQGSREEREEERESEQLEQKEERTGERVEDRERVVERATRRRRGGADEEGERKEGERRGRRGRRRTERERTRAKSERREGNEGR

SEQ ID NO: 787619 - protein, 185 aa, Homo sapiens
MEHVVQACHRFIQASYEPLGISLRPLEAEPPTPPTAPPPGSPRRSEGHPDPPTESRSCSQGPPSPASPDPKACNWKKYKYIVLNSQASQAGSLVGERSSGQPCPQARLPSGDEASSSSSSSSSSSSEEGPIPGPQSRLSPTAATVQFKCGAPASTPYLLTSQAQDTSGSPSERARPLPGKSPSFL

SEQ ID NO: 787620 - protein, 95 aa, Homo sapiens
ARRGQWEEDAAAEVPADTPKPSGQVSMHWSCSWRGRRGGCCPILPTPTTPARPCRGIVDRLTKEHSTEFLTRPPPNHPGHQRQGESEKPSQPRGA

SEQ ID NO: 787621 - protein, 83 aa, Homo sapiens
AQTSCTTSLLRGDASAGPATWGTTLDTIILERHCTLTSQGVDDFLNAKATFKIFDFSDAFVLSKVGFSGILIQKVECSLRSSV

SEQ ID NO: 787622 - protein, 98 aa, Homo sapiens
MGAGRAQWLTSIISALWEAKAGGSPEVRCSGPTWPTWQNPVSTKNTKISQAWWFMSVIPAAWRLRQKNRLNPGGIGCSESRLRHCPPAWATEQDSVSQ

SEQ ID NO: 787623 - protein, 41 aa, Homo sapiens
VQLRIRWSDEGKGRDRNEYWPWGLVDCVGGAQRAAARITGK

SEQ ID NO: 787624 - protein, 561 aa, Homo sapiens
MAIATSTQLARALYDNTAESPQELSFRRGDVLRVLQREGAGGLDGWCLCSLHGQQGIVPANRVKLLPAGPAPKPSLSPASPAQPGSPYPAPDHSNEDQEVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 787625 - protein, 468 aa, Homo sapiens
MAIATSVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 787626 - protein, 468 aa, Homo sapiens; identical to SEQ ID NO: 787625

SEQ ID NO: 787627 - protein, 764 aa, Homo sapiens
GALSECARENRRTAGGASVWAEAATPATQPHGHALGGLWLQATWGKRLSSRSPFLPAGSPQTPALGAPLCSAAGGWRRLAPKLARPAQPPRRLLPALEALLSGLERRRAQPSARLLTRPGPGREFSDPASPGRPRGLGRAAPGAWPSRWRPGGRGDSTQRAPLDAVPQRRPGPPRSSSCLASLPLIWEVLWVFFLLLQPWRRPRLRRHRTQLARALYDNTAESPQELSFRRGDVLRVLQREGAGGLDGWCLCSLHGQQGIVPANRVKLLPAGPAPKPSLSPASPAQPGSPYPAPDHSNEDQEVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 787628 - protein, 683 aa, Homo sapiens
GALSECARENRRTAGGASVWAEAATPATQPHGHALGGLWLQATWGKRLSSRSPFLPAGSPQTPALGAPLCSAAGGWRRLAPKLARPAQPPRRLLPALEALLSGLERRRAQPSARLLTRPGPGREFSDPASPGRPRGLGRAAPGAWPSRWRPGGRGDSTQRAPLDAVPQRRPGPPRSSSCLAEPASHLGSFVGFLSPPPTLAEATTQAPQLGARGRGPWCGAATAEVSKTEPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 787629 - protein, 468 aa, Homo sapiens; identical to SEQ ID NO: 787625

SEQ ID NO: 787630 - protein, 468 aa, Homo sapiens; identical to SEQ ID NO: 787625

SEQ ID NO: 787631 - protein, 160 aa, Homo sapiens [sequence omitted]

SEQ ID NO: 787632 - protein, 392 aa, Homo sapiens
MAIATSVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQVQHWARHCGPLCWLSRELPWATHPALPSKRWCSV

SEQ ID NO: 787633 - protein, 468 aa, Homo sapiens; identical to SEQ ID NO: 787625

SEQ ID NO: 787634 - protein, 81 aa, Homo sapiens
RDHRVLRKGWPESDPYLALAVGGARTITCMLGMTSYGLSSGFLGRWLGKDSIQWFCFVMSELGKKGVYKSVRKRKIEEEMG

SEQ ID NO: 787635 - protein, 308 aa, Homo sapiens
MWRAGEKAWEEDGLGGEGGRHLRLQPAGATVPGPAAEAAAQLSRRQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDGGYWMGLLQKQRVLRYGYLAREVTKLTLGLQIDGLFTKGPLCFRRPRI

SEQ ID NO: 787636 - protein, 347 aa, Homo sapiens
AIGTFNPVDFKKARLTEPSDRICDSVDGGRLRCEGLAPGCGEAGEKAWEEDGLGGEGGRHLRLQPAGATVPGPAAEAAAQLSRRQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDGGYWMGLLQKQRVLRYGYLAREVTKLTLGLQIDGLFTKGPLCFRRPRI

SEQ ID NO: 787637 - protein, 97 aa, Homo sapiens
SIMCAQEVAAVSSWAQIMERLQGKEDAQDFEGLLKALQGLGLCPEELNAVWAVLAAILQLGNICFSSSEVGFPVGRGHLGCWVCRIRAVVMTPNAGV

SEQ ID NO: 787638 - protein, 66 aa, Homo sapiens
MPNSVLWAVDLFGRVYTLSTAGQYWEMCKDSQLEFKRVSATTQCCWGIACDNQVYVYVCASDVPIR

SEQ ID NO: 787639 - protein, 66 aa, Homo sapiens; identical to SEQ ID NO: 787638

SEQ ID NO: 787640 - protein, 36 aa, Homo sapiens
TAVPCTLHTYSMYFHSNPIGSTVMMPPLQIRKLGPG

SEQ ID NO: 787641 - protein, 235 aa, Homo sapiens
METNREELYDLLETLRRLSVTSKVKFIVFNPSFVYMDRYASSLGAPLHNSCISALFLLFFSAFLVADSLINVWITLTVVSVEFGVIGFMTLWKVELDCISVLCLIYGINYTIDNCAPMLSTFVLGKDFTRTKWVKNALEVHGVAILQSYLCYIVGLIPLAAVPSNLTCTLFRCLFLIAFVTFFHCFAILPVILTFLPPSKKKRKEKKNPENREEIECVEMVDIDSTRVVDQITTV

SEQ ID NO: 787642 - protein, 122 aa, Homo sapiens
MVRSSAPGEALKELPIIAEGRGGAGITWQEQEQERETSHELTEQEVTHHKGYGTKPFMRDLLRDPVPPTRPHLQHWGLNFNWRFEGDRHPNHVRCRHIKMINTRSGAVAHTCNPSTLGGRVR

SEQ ID NO: 787643 - protein, 141 aa, Homo sapiens
ASRTLLLASRVLTPKRHYCAGRMCACVCGVCVCCVCVGAWYTWCMYGVCMVCTCGVCGVCVRMWCVCVVCKWCVCGVGCVYTCVYMWHVCGACVCGMLPNLDVEMHPQFATSEESHPGRIGVQTDLMVTGRVGGEREAALR

SEQ ID NO: 787644 - protein, 119 aa, Homo sapiens
GQDKSQSRERAGLMPRKSQASAEAEAVSEHVQGRAGARDRTEPGHSQDRVGQGNSMAGSVLGQGRAGQGDGSGRAGTGQCRAMSCRGQDTSKSTSGPGLWQDKDQGQDQGQVCARASSR

SEQ ID NO: 787645 - protein, 80 aa, Homo sapiens
APLPGDGSLRLGEVGALCDRASESGLRPCPGQDSYQDGLRRPGFAEGPPAGRNPRRKKPQTDRRGGSAGSQPQACADGVR

SEQ ID NO: 787646 - protein, 104 aa, Homo sapiens
SAGITGVSHRTQPCLEYFCNGKMKWEKSLFLALRLTLKPQINIAAMADRRVCGEKRGLRPHKRDQRSFDRGRKPVHQMVWSTWAAVGKALSPRSTEQLIRMQGL

SEQ ID NO: 787647 - protein, 73 aa, Homo sapiens
NMEFVNKKVQRRKLPGGDLMSSRDTIGSPKECATESLILVLFLSADMNKRKISADGQATSSKHCLVEYMEPLG

SEQ ID NO: 787648 - protein, 287 aa, Homo sapiens
HSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 787649 - protein, 122 aa, Homo sapiens
ENKGRKHELRWGAGAKAGPQSVHRCLQKPAAVFGHLRSLGARHQPLLLSLALDRTEVDTWGLLENHLEHVELKSESLIFCCVGSRASLDRTYSGACSQVGEWKYLLSPHTRELEMRQPILPA

SEQ ID NO: 787650 - protein, 85 aa, Homo sapiens
MPVAHILGSSRDPFKILIPTLGSRTRFLKLSTIGISDRITFHCEGLSCALRMFSSIPGLHTTRCQYSSHPQVEKAKNVSRYCQIS

SEQ ID NO: 787651 - protein, 74 aa, Homo sapiens
GRRAERKESGEKCRLRSSPYNSSKRASRRYYHNDTVQIKAKIKIIWPIQQATLPRTQMAAFLRPSARASSPPIS

SEQ ID NO: 787652 - protein, 104 aa, Homo sapiens
MSFEDLLSGVHCLPLSFEGGSRGLGTIPASPQHPLTPGVWVRVALTQEPCPTWMLISLCHSVISTTSCSNSLRERSLPSRAERTSSSSVCSRLKRRSCRLYCFR

SEQ ID NO: 787653 - protein, 236 aa, Homo sapiens
MGDHSKKKPGTAMCVGCGSQIHDQFILRVSPDLEWHAACLKCAECSQYLDETCTCFVRDGKTYCKRDYVRLFGIKCAKCQVGFSSSDLVMRARDSVYHIECFRCSVCSRQLLPGDEFSLREHELLCRADHGLLLERAAARQPAQPRPASRRPRPASARRWVGPAARVRPHVHKQTEKTTRVRTVLNEKQLHTLRTCYAANPRADALMKEQLVEMTGLSPRVIRVWFQNKRCKDKKS

SEQ ID NO: 787654 - protein, 97 aa, Homo sapiens
GRDMGDPSGLVSLSSVTLSTTCGQMASYPLTLVRTRMQAQDTVEGSNPTMRGVLQRILAQQGWLGLYRGMTPTLLKVLPAGGISYVVYEAMKKTLGI

SEQ ID NO: 787655 - protein, 88 aa, Homo sapiens
ALCSSGLKSVVCEQKTAAVGSRSSLRACCYCSLLESDPKYPTSCSLTLKLTPIYAQKSMHHSYSTTKILPGKTLVGHRSLNVVAEYSS

SEQ ID NO: 787656 - protein, 203 aa, Homo sapiens
ALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGIVKIYK

SEQ ID NO: 787657 - protein, 54 aa, Homo sapiens
AANNDKDDEGKYSSWRWGLKGQQPAPAHRMRYQHCPLPGPLGLPDPGLQCACPP

SEQ ID NO: 787658 - protein, 95 aa, Homo sapiens
MPLILPDTLFSSLASPGGLLSAVGAGPPPARPSLPLTYAPRTPAVAINTPSAGVCDSRPAATFSAQTDGWHTWLPALGDNRLLLPGTPHPSAVQT

SEQ ID NO: 787659 - protein, 186 aa, Homo sapiens
GGLAWRAAALAHPLPRKGSGPRRRLPMARLRDCLPRLMLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKGYFRFFRV

SEQ ID NO: 787660 - protein, 34 aa, Homo sapiens
MGLAREEGTSAGGNQCRDGTNTPERLARLLERAL

SEQ ID NO: 787661 - protein, 71 aa, Homo sapiens
DTGIGVCLIRAPMPPPVTESCRREGAVAYVTVRHLVWTLFYPCLLCKVPSTMKLGYASSCQNGCRICLGAM

SEQ ID NO: 787662 - protein, 89 aa, Homo sapiens
MLPLTLEAHPWSYSWAGLTFASGPVCLCFQEPERCPGKLPGHLQALAARERQSSGRAQSSEHHVILTYNSGHPEPQSSEHHVILTYNSG

SEQ ID NO: 787663 - protein, 346 aa, Homo sapiens [sequence omitted]

SEQ ID NO: 787664 - protein, 113 aa, Homo sapiens
AGVNELMQVLCPCLASQVWYREDVSHSNPEGSSWSLLDTPGEVVQISCGPHDLLWATLWEGQALVREGINRSNPKGSSWSIVEPPGSENGVMHISVGVSVVWAVTKDWKVRWG

SEQ ID NO: 787665 - protein, 1123 aa, Homo sapiens
QCCWGIACDNQVYVYVCASDVPIRRREEAYENQRWNPMGGFCEKLLLSDRWGWSDVSGLQHRPLDRVALPSPHWEWESDWYVDENFGGEPTEKGGWTYAIDFPATYTKDKKWNSCVRRRKWIRYRRYKSRDIWAKIPSKDDPKELPDPFNDLSVGGWEITEEPVGRLSVWAVSLQGKVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSRGLPTDRYMWSDASGLQECTKAGTKPPSLQWAWVSDWFVDFSVPGGTDQEGWQYASDFPASYHGSKTMKDFVRRRCWARKCKLVTSGPWLEVPPIALRDVSIIPESPGAEGSGHSIALWAVSDKGDVLCRLGVSELNPAGSSWLHVGTDQPFASISIGACYQVWAVARDGSAFYRGSVYPSQPAGDCWYHIPSPPRQRLKQVSAGQTSVYALDENGNLWYRQGITPSYPQGSSWEHVSNNVCRVSVGPLDQVWVIANKVQGSHSLSRGTVCHRTGVQPHEPKGHGWDYGIGGGWDHISVRANATRAPRSSSQEQEPSAPPEAHGPVCC

SEQ ID NO: 787666 - protein, 1123 aa, Homo sapiens; identical to SEQ ID NO: 787665

SEQ ID NO: 787667 - protein, 996 aa, Homo sapiens
AVPGEVYDIPSKDDPKELPDPFNDLSVGGWEITEEPVGRLSVWAVSLQGKVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSRGLPTDRYMWSDASGLQECTKAGTKPPSLQWAWVSDWFVDFSVPGGTDQEGWQYASDFPASYHGSKTMKDFVRRRCWARKCKLVTSGPWLEVPPIALRDVSIIPESPGAEGSGHSIALWAVSDKGDVLCRLGVSELNPAGSSWLHVGTDQPFASISIGACYQVWAVARDGSAFYRGSVYPSQPAGDCWYHIPSPPRQRLKQVSAGQTSVYALDENGNLWYRQGITPSYPQGSSWEHVSNNVCRVSVGPLDQVWVIANKVQGSHSLSRGTVCHRTGVQPHEPKGHGWDYGIGGGWDHISVRANATRAPRSSSQEQEPSAPPEAHGPVCC

SEQ ID NO: 787668 - protein, 1145 aa, Homo sapiens
AVPGEVYDIPSKDDPKELPDPFNDLSVGGWEITEEPVGRLSVWAVSLQGKVWYREDVSHSNPEGSSWSLLDTPGEVVQISCGPHDLLWATLWEGQALVREGINRSNPKGSSWSIVEPPGSENGVMHISVGVSVVWAVTKDWKVWFRRGVNSHNPCGTSWIEMVGEMTMVNVGMNDQVWGIGCEDRAVYFRQGVTPSELSGKTWKAIIAARECDRSHSGSSSSLLSAGCFFGDEVRGSGESAPSDTDASSEVERPGPGQILPAEPLDDSKNATGNSASGLGAGRTAEDTVEDACPAEGSREARPNTHPGPAPTPAELPWTNIDLKEAKKVPSHSAAGFPETTSLSSLGLLPLGLEEPYGVDDHPLWAWVSGGGCVVEACAMPRWFTVQAGKGSCRAWGHPHGQVPWGCGVWEEAGAGGSGRPAVLPGRLTVLSSSEPGIALLCGLQRPARGCQDLEARWPVPLPLSAAPPLCQRWWLLSRLNYWGRATHPTGQRVEGGLTESVAFELERADLVEGSAVASCPAAGRTVPRPWGSLCPTGLSSSVHMLSLSITPAQTAAWRKQIFQQLTERTKRELENFRHYEQAVEQSVWVKTGALQWWCDWKPHKWVDVRLALEQFTGHDGVRDSILFIYYVVHEEKKYIHIFLNEVVALVPVLNETKHSFALYTPERTRQRWPVRLAAATEQDMNDWLALLSLSCCESRKVQGRPSPQAIWSITCKGDIFVSEPSPDLEAHEHPLPCDQMFWRQMGGHLRMVEANSRGVVWGIGYDHTAWVYTGGYGGGCFQGLASSTSNIYTQSDVKCVHIYENQRWNPVTGYTSRGLPTDRYMWSDASGLQECTKAGTKPPSLQWAWVSDWFVDFSVPGGTDQEGWQYASDFPASYHGSKTMKDFVRRRCWARKCKLVTSGPWLEVPPIALRDVSIIPESPGAEGSGHSIALWAVSDKGDVLCRLGVSELNPAGSSWLHVGTDQPFASISIGACYQVWAVARDGSAFYRGSVYPSQPAGDCWYHIPSPPRQRLKQVSAGQTSVYALDENGNLWYRQGITPSYPQGSSWEHVSNNVCRVSVGPLDQVWVIANKVQGSHSLSRGTVCHRTGVQPHEPKGHGWDYGIGGGWDHISVRANATRAPRSSSQEQEPSAPPEAHGPVCC

SEQ ID NO: 787669 - protein, 1145 aa, Homo sapiens; identical to SEQ ID NO: 787668

SEQ ID NO: 787670 - protein, 204 aa, Homo sapiens
MPLHSSLGDRDSISKKKKKKSEGRRQQIGNNTGVDGMSSSLRGPGYQTGGWERMRGCPMAGGSVRVCSHHHQPPFGPFPRCAGDRGFLDVKSCCRRVQTAGFCGEQYYCVCRQWPWDPQPVLYMEQGAQSPSILWREAGPARPGEAEGVGQVAPTPSRNLSAAFYYLCAPFGSLLPPPGHFAREVIRAQPQALLGWRGDDFTTT

SEQ ID NO: 787671 - protein, 114 aa, Homo sapiens
MKVPFLHPCLPPAIHPSQVSCLPWASVTTFWALCQLLATWCGQLRPSPRLYYSLKLQRPGGCSLTLWDGLLSSQGVPGSRARGQAYHIQDAYRQECPAPALPGSQYSSMHRGRW

SEQ ID NO: 787672 - protein, 37 aa, Homo sapiens
PFPISTKSHSFDFPGVFWLCLLLSFCSIPTLAQALIS

SEQ ID NO: 787673 - protein, 118 aa, Homo sapiens
MLPKLEGFSRVKLIFKYGLHLTGTPFMRLQAYHFKSREVASMNCQVFKSRMAQEFSDPSFARQGLEPHCSLSLRTQQNLSYQGLTLGISSLMLALRCAVAQLTVGTRHLVNQSKDIIS

SEQ ID NO: 787674 - protein, 155 aa, Homo sapiens
AQNGEGQAVGSTGKGNLWLVKKHYSERTSGKEWANRNRSSHSRLQVSGCFWLEGGVSPGTHPCLSGHLTASCCFHKELPKMVIYKEKRFKWLTVPQAIRKHGWGGLRKLTVMTEGEAGMSHMVEQEEELTYSKLFKTEHLSLFCSLSGRTLLPPP

SEQ ID NO: 787675 - protein, 43 aa, Homo sapiens
RAHVPGLPASHRARRCSSNGAPGPPAAPLLCIGRSLPAPSFGF

SEQ ID NO: 787676 - protein, 431 aa, Homo sapiens
SARSSLSVELGDCSCGEISVHCLPWVLFILDLKVESSMFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 787677 - protein, 410 aa, Homo sapiens
SARSSLSVELGDCSCGEISVHCLPWVLFILDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 787678 - protein, 204 aa, Homo sapiens
MSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 787679 - protein, 381 aa, Homo sapiens
SARSSLSVELGDCSCGEISVHCLPWVLFILDLKVESSMFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEVNTRFSLKH

SEQ ID NO: 787680 - protein, 229 aa, Homo sapiens
SARSSLSVELGDCSCGEISVHCLPWVLFILDLKVESSMFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKVTRRKHHCVREGSG

SEQ ID NO: 787681 - protein, 128 aa, Homo sapiens
CPHKNLHMNIYREALFTTAKIWKQPRCLSVGKWINCGKSSFLKRKSRILKKRRKTGSPCGLGPKMGNESPIWKSVSECPSGVHFPWETVQSRPLESTLTLLISESHLRSSQETMRRNCSRVCPMCSLR

SEQ ID NO: 787682 - protein, 34 aa, Homo sapiens
HADRAQLFSVHRRNPFNKGGLLCFLLEGQLIVQG

SEQ ID NO: 787683 - protein, 110 aa, Homo sapiens
MKALGARVGECPGCQSPQRMLPESSRVLLPRCAEGEQPGVQRGKGRMRKAFPALQTPLALPSSAPASPGAGKPSHTGSWLPLRLLKRQHWRWEPWTACKEAVQHLVITEL

SEQ ID NO: 787684 - protein, 113 aa, Homo sapiens
LEQLIVGRGGWAIVPDGGHLAEAVRRQEVARVHDVRTGVNLRREDGDVGEVLKIGGVLVQSLKLQPQLQLGHGPGARGARGPPGSAAPAGPSLWGRRKCGVRTGQVAKAGWPD

SEQ ID NO: 787685 - protein, 138 aa, Homo sapiens
LRPQAELHVHPHQGALHRGPGLARPCSAPHGQLLTALWAHRGSSRRSWSLGGRQLRAASLSLPRPPRVSAKACLRFSPFDCQTFRFSLSKPEKFLTLFFFASWKHKLFEIRFLHQHILFSWPLRGRSPWASHLLGRPS

SEQ ID NO: 787686 - protein, 72 aa, Homo sapiens
ASQGSADTFIPRLSHNGEHLLGTHLEPLNRHVSILVLDPNNLVFTPHCTDEEQGMDVEKLKLLKRLTAVFIF

SEQ ID NO: 787687 - protein, 61 aa, Homo sapiens
LLPPQLIFLSLFANHFPAMLTPLWPLDRERDDGDHMGFICSMSSTQHRAPTELRQGPSLTT

SEQ ID NO: 787688 - protein, 67 aa, Homo sapiens
EFARTNSNEDVSPCAIYENDCAVKAPGGLDEECFHLLLHSSSLALILATYTVSTKELLPSSSSLLHT

SEQ ID NO: 787689 - protein, 125 aa, Homo sapiens
GGRDTRMGTSQLVQASAPPSSSSLAGSSSGLLRCCAAPSLALGPPVPEMKEELLPWTVPVQAGGRWPQDTRHPRHRDTRSPGSASEVQQPQSPCSEASDGRAGPACGTHHGRSNRQALGRQQHSL

SEQ ID NO: 787690 - protein, 116 aa, Homo sapiens [sequence omitted]

SEQ ID NO: 787691 - protein, 83 aa, Homo sapiens
SPMCSAPVYRPASHRMPTVTTCQPWQTTWGPPSDLLVGLCTLVPVLLLAWGPPPALCLNGSVEPSELTYQLLQKVVPDPASRP

SEQ ID NO: 787692 - protein, 148 aa, Homo sapiens
GAPAYISMGPLEFSGIYQHTGLREEFSKDRGPGCMVTKPTQREGMLEWARVPVPQQATPGNRPTPRPEDEQRAPTGTSTSHSSPMCPGKPSPGVPALLRVESGCLWLFFLLWKFPRSRDRLYSEPHEDPLNRLWLLDEGLTLHPTPSV

SEQ ID NO: 787693 - protein, 136 aa, Homo sapiens
AYISLCSSLLMLILLMLILLMLILLMPILLMLILLMLILLMLIPPYAIPPYAHPSLCSSLLMLIPPYAHPSLCSSLLMLIPPCNGCSLGPASPQFVGQARRWGSETRMSCVPEMLCRTTLETVLLQGSKTVWLNTG

SEQ ID NO: 787694 - protein, 53 aa, Homo sapiens
MPTISSTEKRDMQSFSTPFITFKFLSVSSRYLLLIFCDFPGHEKGSEVDSGAL

SEQ ID NO: 787695 - protein, 222 aa, Homo sapiens
RVHLLSSGKVPASCLPARRPISAFRPSCGLRPTPARAPHGCRRGQACGAGLRRVGAGPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGI

SEQ ID NO: 787696 - protein, 383 aa, Homo sapiens
SVSTSCPPERCPPLAFRPGARFPPSDPAVGCAPRQPAPRMAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 787697 - protein, 238 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGKQFQDFIH

SEQ ID NO: 787698 - protein, 77 aa, Homo sapiens
GSPGLQAAPGHILVLSRLQPLRAEVSRSRLLRVEYSYVKTTKLVFKGTKAKRRDGKKVSRSELKPLPLRTLSRSLGS

SEQ ID NO: 787699 - protein, 120 aa, Homo sapiens
SVSTSCPPERCPPLAFRPGARFPPSDPAVGCAPRQPAPRMAAAGARPVELGFAESAPAWRLRSEQFPSKVGGRQHSLSAGALLSSIFLALSQSFSGRLNFTIHPTRVLPTYRKLLMRLVV

SEQ ID NO: 787700 - protein, 354 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 787701 - protein, 354 aa, Homo sapiens; identical to SEQ ID NO: 787700

SEQ ID NO: 787702 - protein, 308 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQFSDTVY

SEQ ID NO: 787703 - protein, 303 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQV

SEQ ID NO: 787704 - protein, 312 aa, Homo sapiens
RVHLLSSGKVPASCLPARRPISAFRPSCGLRPTPARAPHGCRRGQACGAGLRRVGAGVATAQRAVPALLPAAGVCAAAWPPGRLPPLHLPLLLPRAAVLCRPARVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 787705 - protein, 231 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMDS

SEQ ID NO: 787706 - protein, 341 aa, Homo sapiens
RVHLLSSGKVPASCLPARRPISAFRPSCGLRPTPARAPHGCRRGQACGAGLRRVGAGVATAQRAVPQQGGRAAGMAGRGRAAGAPGPGLRAVRPPALLPAAGVCAAAWPPGRLPPLHLPLLLPRAAVLCRPARVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 787707 - protein, 231 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGI

SEQ ID NO: 787708 - protein, 138 aa, Homo sapiens
SVSTSCPPERCPPLAFRPGARFPPSDPAVGCAPRQPAPRMAAAGARPVELGFAESAPAWRLRSEQFPSKVGGRPAWLGAAGLPGPQALACELCGRPLSFLLQVYAPLPGRPDAFHRCIFLFCCREQPCCAGLRGFVAV

SEQ ID NO: 787709 - protein, 168 aa, Homo sapiens
SVSTSCPPERCPPLAFRPGARFPPSDPAVGCAPRQPAPRMAAAGARPVELGFAESAPAWRLRSEQFPLSFLLQVYAPLPGRPDAFHRCIFLFCCREQPCCAGLRGEPPNGVGTGPCLRRVRGVNSGSDQGDGGKHRCRPSLRAPSPRCPRSTFSRALPGCAHFCYISF

SEQ ID NO: 787710 - protein, 138 aa, Homo sapiens; identical to SEQ ID NO: 787708

SEQ ID NO: 787711 - protein, 231 aa, Homo sapiens; identical to SEQ ID NO: 787707

SEQ ID NO: 787712 - protein, 260 aa, Homo sapiens
SVSTSCPPERCPPLAFRPGARFPPSDPAVGCAPRQPAPRMAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGI

SEQ ID NO: 787713 - protein, 168 aa, Homo sapiens; identical to SEQ ID NO: 787709

SEQ ID NO: 787714 - protein, 138 aa, Homo sapiens; identical to SEQ ID NO: 787708

SEQ ID NO: 787715 - protein, 431 aa, Homo sapiens
MTRDRKQYQHCNAQYHRTTKQKREARRGENTDKRRSKTTRDEKPYMRDRNSTKKHTGESAAEKTRHNTRSENTKQKEEHTREKPNRPKRYWYERKKAKNTNTKKEEKRNAASGAYTKENKNEANTTRRSTTDDTKETHNTTKQNTGTTTDSRQIEQENTGAEAEKNQDAKRSDEEKDTAKSRKTERGDRGADEEGERAGEEGGRGEEEEERGREKEGEEREKRGRQHEETREGEREQDAKREREKGEAERKRSESRRRGEEKGREEGGASRNSASRKTGETLREGARRHKAEEGDESDQEQDDEARGRGTARDTKTTTTDRGPRETDEEEREGGTKRQGRRQTREQHRAKETEAANEDERAEQATDEDERTARAQRRKGERGNRPERKAEHNRQADTSAQRTQHNRSRSKEEGRRSKREGKHEEGENRQQE

SEQ ID NO: 787716 - protein, 102 aa, Homo sapiens
RGSRVVLVSGVCWRKGTETEDVRCEQCARWYLLSMCLLAVMKCKSIHRLSESEPGGDQAGDRGDRQSLWHTPVLLQIHLTFPCHSKINFRNTESNLTHLVLK

SEQ ID NO: 787717 - protein, 248 aa, Homo sapiens
MGARANIGRQKFGGDNSFPQGGGILNSPSRDFGVFGAPKKTTRGVEHWDKINPAKIQKTCWWLHTRGKNNKQASIMLGTHLMPPPRGGSLTGAKKNHRGPQKRLGGPYTLARSRSVSTTLAKTTKELSGAGKRNSFPYKTQGPSARGPFLIFVAVPPSLGGQGHSGVRKTPVGRTRRLQLASGFGGSRRPPVMSLLLGPEFRVPSGGNTFPRSQREMPLFDNFAVVGASWAHRVSARAGKTPPLCFWF

SEQ ID NO: 787718 - protein, 122 aa, Homo sapiens
SFLRKNCCYFFRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEVLNI

SEQ ID NO: 787719 - protein, 75 aa, Homo sapiens
GTRSPPRVLRLNSFSSLISRRRRLLANAGQPPACVLWVSPSVSSHCLRLGPNTAVHFLESLLHSCCRSYESRGKL

SEQ ID NO: 787720 - protein, 154 aa, Homo sapiens
KDDDVEHIMVRRPGALAETTLLIFPATVFYIHAVEAMKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKISEEDLRKELHFCCLHWP

SEQ ID NO: 787721 - protein, 75 aa, Homo sapiens; identical to SEQ ID NO: 787719

SEQ ID NO: 787722 - protein, 105 aa, Homo sapiens
MKVVGNYRVNTANSSTDTSGEHLTCLRSQLFVAYRNGRVDEAVSLGFLDCWIGGDLTNFKGCYLTNQLPIQIFQPQLFKDSITREKVRLSLWGVLCPVYIPYSFR

SEQ ID NO: 787723 - protein, 118 aa, Homo sapiens
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKISEEDLRKELHFCCLHWP

SEQ ID NO: 787724 - protein, 108 aa, Homo sapiens
KDDDVEHIMVRRPGALAETTLLIFPATVFYIHAVEAMKVVGNYRVNTANSSTDTSGEHLTCLRSQLFVAYRNGRVDEAVSLGFLDCWIGGDLTNFKGCYLTNQLPIQF

SEQ ID NO: 787725 - protein, 136 aa, Homo sapiens
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKIYSNLSYSKTPSPERKSDCHFGESSALYISHILSDK

SEQ ID NO: 787726 - protein, 89 aa, Homo sapiens
RTKLSIQHYEMTIPTASQNQAQYPVSPSVTFQHLHLELTITPEPTMEAEHSIMLRMTTAPPKHPEVTLPPSDHVQAQHTNLRPQCNLWI

SEQ ID NO: 787727 - protein, 149 aa, Homo sapiens
VTCFMASARRTTDTRPQPPRGIAPRLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCY

SEQ ID NO: 787728 - protein, 54 aa, Homo sapiens
RDTLPEHWSYGVCRDGRVFFINDQLRCTTWLHPRTGEPVNSGHMIRSGGRRAGG

SEQ ID NO: 787729 - protein, 88 aa, Homo sapiens
TPSLRCSGLNMPLTYLYISDFLLSKSGHLSLAVTLNEPPPPPFPSGIEHALPLTQSTTVLTRQDGGCVQRRSRLEVGSGTAQLSYVIF

SEQ ID NO: 787730 - protein, 33 aa, Homo sapiens
MPEHRGALDTVFPNQDSIEHKCSEGMSEDAAGC

SEQ ID NO: 787731 - protein, 116 aa, Homo sapiens
LEGRVTWNLCKSQAIRELHGTGEIVNVYDHEISEYVYQFHLWKTLFQAPVAKGNSNIMTSVSTQLSLVLMSLLLVLPVVEAVEAGDAIALLLGVVLSITGICACLGVYARKRNGQM

SEQ ID NO: 787732 - protein, 200 aa, Homo sapiens [sequence omitted]

SEQ ID NO: 787733 - protein, 114 aa, Homo sapiens [sequence omitted]

SEQ ID NO: 787734 - protein, 110 aa, Homo sapiens
FSNTCFLLWGRDDNRVACDYHSPLQYPWQAPLSTDKIPSCQAQTTASESMTQCTRRPLSTYLFCYVKGSLSSLSKGEPTAIQVGNQTSLEARRQNPTSIIKEHQNLIDRP

SEQ ID NO: 787735 - protein, 179 aa, Homo sapiens
FFLFFRTAQAPGAKNNRGSGERRVPAARISGPKRGWRRRGRPMQRIARRRRQPGCCGRQLKNGSRKLLLTMNEGIRFTRQGPPAKLGFPAGFSNHICISPPLNPPRTVPTAHWAATSLLQSQSWSRAATCWFPLAAVHHGYRGDRDPICIGLLDWLAEEQFLGGGAKNFLLSHGRPRLA

SEQ ID NO: 787736 - protein, 129 aa, Homo sapiens
MVRGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPK

SEQ ID NO: 787737 - protein, 539 aa, Homo sapiens
RGPQGQGHGRMALNLQLSDTDDNETFDELHIESSDEKSPSDVSLAADTDKSVENLDVLVGFGKSLCGSPEEEEKQVPIPSETRPKTFSFIKQQRVVKRTSSEECVTVIFDAEDGEPIEFSSHQTGVVTVTRNEISINSTPAGPKAEHTELLPQGIACLQPRAAARDYTFFKRSEEDTEKNIPKDNVDNVPRVSTESFSSRTVTQNPQQQKLVKPTHNISCQSNSRSSAPMGIYQKQNLTKIPPRGKSSPQKSKLMEPEATTLLPSSGLVTLEKSPALAPGKLSRFMKTESSGPLFELRSDPHIPKHSAQLPHSSRMPSRRDWVQCPKSQTPGSRSRPAIESSDSGEPPTRDEHCGSGPEAGVKSPSPPPPPGRSVSLLARPSYDYSPAPSSTKSETRVPSETARTPFKSPLLKGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPK

SEQ ID NO: 787738 - protein, 116 aa, Homo sapiens
WPLPACHGFSKCAMVKRTPDHLLLEPVTSWLHHKENLPLTCLESPRAGRGVSSQCPPNPTPMSWKQMRGCRTGKPPGEERMLLRQEQVLRALPAGLGSSNPQVHSPGTAHMASGGP

SEQ ID NO: 787739 - protein, 115 aa, Homo sapiens
DWVQVMLIGSGDADWVQVMLADWVRVMLADWVQMMLADWVQVMLIDWVQVMLADWVQMMLADWVWVMLADWVQVMLADWVQVMLIAWVQVMLADHVDLVQEVLGTVNQLVLVEAY

SEQ ID NO: 787740 - protein, 220 aa, Homo sapiens
RLAGAGKMAAAAAAAAATNGTGGSSVMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGE

SEQ ID NO: 787741 - protein, 102 aa, Homo sapiens [sequence omitted]

SEQ ID NO: 787742 - protein, 82 aa, Homo sapiens
MEAICHVCCVRRGCCVVRALCVPHVLCVVLRCVLCVPQVLCVVHALCVVCVLHAVCALRVVHVLCVLCVVHALCVVCVPRVL

SEQ ID NO: 787743 - protein, 116 aa, Homo sapiens
LTLSRKSAESPSINQEKNNAELQNANLLPPALLPNSKPTHRVLKAQRCLPAVLLHFVEEKLAAATANPDVNSTLTSWGPYPQKFHRTTHQLHSLHLLLLCKPSLGFFLHCFKTNLR

SEQ ID NO: 787744 - protein, 69 aa, Homo sapiens
VEGNSYEQNEQSLPNNLRDALRELDDSEVMAKYIDPKYIDIFVACEESELEEFEHSISDLEYNWYLHTV

SEQ ID NO: 787745 - protein, 968 aa, Homo sapiens
MKFFVFKSFLSDCYRSLLDNSQLPAPRSRLPAPGARRGAVPQTTRSRGGWVWGRGSQCRRIGPQSAVLLSPEAAWMEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 787746 - protein, 715 aa, Homo sapiens
MLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEEDSFLEKEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 787747 - protein, 968 aa, Homo sapiens; identical to SEQ ID NO: 787745

SEQ ID NO: 787748 - protein, 976 aa, Homo sapiens
MKFFVFKSFLSDCYRSLLDNSQLPAPRSRLPAPGARRGAVPQTTRSRGGWVWGRGSQCRRIGPQSAVLLSPEAAWMEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEEDSFLEKEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 787749 - protein, 735 aa, Homo sapiens
MKFFVFKSFLSDCYRSLLDNSQLPAPRSRLPAPGARRGAVPQTTRSRGGWVWGRGSQCRRIGPQSAVLLSPEAAWMEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKELCTCCLREEMVQIHVVTLH

SEQ ID NO: 787750 - protein, 976 aa, Homo sapiens; identical to SEQ ID NO: 787748

SEQ ID NO: 787751 - protein, 222 aa, Homo sapiens
PRAESARGWVWGRGSQCRRIGPQSAVLLSPEAAWMEPPLPVGAQPLATVEGMEMKGPLREPCALTLAQRNGQYELIIQLHEKEQHVQDIIPINSHFRCVQEAEETLLIDIASNTCYSVPSGLSAWERRRLRLLLFSDILEADDLGLQVFQNDLKSHATGRVYCRISSSVYSKKEERFLIPPLPYPTQKNTFRLILPSQSYHILVFLCFLFIRQKDLYLHSFT

SEQ ID NO: 787752 - protein, 949 aa, Homo sapiens
MKFFVFKSFLSDCYRSLLDNSQLPAPRSRLPAPGARRGAVPQTTRSRGGWVWGRGSQCRRIGPQSAVLLSPEAAWMEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEEDSFLEKEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIVLSSLSPPCPLGDP

SEQ ID NO: 787753 - protein, 490 aa, Homo sapiens
MKFFVFKSFLSDCYRSLLDNSQLPAPRSRLPAPGARRGAVPQTTRSRGGWVWGRGSQCRRIGPQSAVLLSPEAAWMEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHE

SEQ ID NO: 787754 - protein, 977 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 787755 - protein, 740 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGSCSSTGCRTT

SEQ ID NO: 787756 - protein, 730 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIARRAADNLRRHHQYQEVMRNLVKRYVAAMIRDAKTEEGLTEENFKELKQDISSFRFEVLGLLRGSKLSTIQSANASKESSNSADSDEKSDSEGSCSSTGCRTT

SEQ ID NO: 787757 - protein, 430 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGKCVTIENIIKTCYCHGIS

SEQ ID NO: 787758 - protein, 977 aa, Homo sapiens; identical to SEQ ID NO: 787754

SEQ ID NO: 787759 - protein, 795 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGSCSSTGCRTT

SEQ ID NO: 787760 - protein, 90 aa, Homo sapiens
PRLPWLRFQSILTPPSSVPAAWAPASIVFLGMLQNSAATKGIPLEFAGRALTPHGTRAVSPRIPSLQPEDCNFAGKEDVASGLRSTGATP

SEQ ID NO: 787761 - protein, 112 aa, Homo sapiens
NKIIMVRRPKQSTADYGMRTSGPVESGLSADSLQLLCSYAAIKNSAELLMVGPQGMRPATGQDLLCRPCLSHDPPGPLHPPRGLSGSSSLLISPRLQDVSLQLVHPTPEESF

SEQ ID NO: 787762 - protein, 87 aa, Homo sapiens
HSRVSPPRTPNVGHQDLAFEPSMSPVVSTSGVLPVTLNFDILVRLVLDELLGSFFDNLGLHKESEVGPDAKEEMAPLSFFLFYHSLP

SEQ ID NO: 787763 - protein, 214 aa, Homo sapiens
MASADKNGGSVSSVSSSRLQSRKPPNLSITIPPPEKETQAPGEQDSMLPEGFQNRRLKKSQPRTWAAHTTACPPSFLPKRKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTP

SEQ ID NO: 787764 - protein, 185 aa, Homo sapiens
MASADKNGGSVSSVSSSRLQSRKPPNLSITIPPPEKETQAPGEQDSMLPERKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTP

SEQ ID NO: 787765 - protein, 120 aa, Homo sapiens
MASADKNGGSVSSVSSSRLQSRKPPNLSITIPPPEKETQAPGEQDSMLPEGFQNRRLKKSQPRTWAAHTTACPPSFLPKRKNPAYLKSVSLQEPRSRWQESSEKRPGFRRQASLSQSIRK

SEQ ID NO: 787766 - protein, 42 aa, Homo sapiens
LALCIGKERQVAGVSSPVLFDIIYCCFCSFLVWLLLWFGCVP

SEQ ID NO: 787767 - protein, 151 aa, Homo sapiens
HSLSRARTLTLGAYVCVGPPASPQAPPQTPSPAQKPPPRAGPSSHTCWDPGGQPSALPHNPASLPHLFLLPPPSLPRFLHFSLHALPLPGSLSLLLSFFLSGSGWFSVRRPAGPGGFAQASKYSALDSCPAHKRSAPCSGAISHRPAAANP

SEQ ID NO: 787768 - protein, 126 aa, Homo sapiens
VIIMFIPMRIIVMLDHENDAVMINNSPIRLMWGGSCPCEYGVSEGFTSSRMWNSSQALEYDDGLGSQRGSSCEYLCLVPLLSDGFGLLWVSSLSVYPFLHPFLGISSLDDFLFYSQAVVSIHAICK

SEQ ID NO: 787769 - protein, 253 aa, Homo sapiens
PAFRKPAPGAMGAQVRLPPGEPCREGYVLSLVCPNSSQAWCEITNVSQLLASPVLYTDLNYSINNLSISANVENKYSLYVGLVLAVSSSIFIGSSFILKKKGLLQLASKGFTRAGQGGHSYLKEMALVGRIAVNAILSSYFLNEHLNIHGKIGCILSILGSTVMVIHAPQEEEVTSLHEMEMKLRDPGFISFAVIITVISLVLILIVAPKKGQTNILVYISICSLIGAFSVSSVKGLGIAIKELIEWKPVYKH

SEQ ID NO: 787770 - protein, 133 aa, Homo sapiens
VNGITFISVARPKICPKSCLFTPISNQVTITGFCFQHDCIFLFSPNSPIWEFSTSCLECLHNGYSLPSQKLHTLHVATALKSLLLKSFMVASPLNSIMSRFLHEASDKLAPTFPTLLFYFPFPNLMTIYMQLL

SEQ ID NO: 787771 - protein, 94 aa, Homo sapiens
QSSVLQERLQGLGKWPRIQSQTSGAVNSDSTFFQVNHLVKLLDVPLRFFLPIPELGSIRCQKVGRLINKDVEMPAWSLVLELLSSLGWMVPPAL

SEQ ID NO: 787772 - protein, 343 aa, Homo sapiens
SRGSQDVSVNWRLAAVVAVESAEGGGGDEEVCMLGGTVRVDNFYVVLDPKLLSDTEYLLLLLIITLIVWGLGNGQWRMNFRGIAPVLRKYLNLLRSLRVCGGINTGATEIERSLKTLERSAEKLHLIFQKIHRPLSMTPERSASPNFLEGQVAFSHPRLSNNRSVMPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFQRQYDQAMVRLFHAWLNMDRMLRSSMRLCLPSFDKLYLLECIRRLIEVMKDWVLDAASTSLYVRQ

SEQ ID NO: 787773 - protein, 212 aa, Homo sapiens
MLTSYATPERSASPNFLEGQVAFSHPRLSNNRSVMPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFKRQYDQAMVRLFHAWLNMDRMLRSSMRLCLPSFDKLYLLECIRRLIEVMKDWVLDAASTSLYVRQ

SEQ ID NO: 787774 - protein, 272 aa, Homo sapiens
MYLGSREVLECSRCCGPWWYTSNGYRLMQLPTEWQSRSGFGLSPIFRGGCLPWGKLVAGRENELPRTPELTEHEEFRQGQVAFSHPRLSNNRSVMPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFKRQYDQAMVRLFHAWLNMDRMLRSSMRLCLPSFDKLYLLECIRRLIEVMKDWVLDAASTSLYVRQ

SEQ ID NO: 787775 - protein, 212 aa, Homo sapiens
MLTSYATPERSASPNFLEGQVAFSHPRLSNNRSVMPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFQRQYDQAMVRLFHAWLNMDRMLRSSMRLCLPSFDKLYLLECIRRLIEVMKDWVLDAASTSLYVRQ

SEQ ID NO: 787776 - protein, 178 aa, Homo sapiens
MPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFKRQYDQAMVRLFHAWLNMDRMLRSSMRLCLPSFDKLYLLECIRRLIEDDKDWVLDAASTSLYVRQ

SEQ ID NO: 787777 - protein, 175 aa, Homo sapiens
MPRHEGLGPRRAPGISCSTHGHTGNPLNPIRDGDRGLQLFPMNEEFPVSAGHKLALIKSLPFVHTARRYYRLDGLVRPAPNSALPEPHAATQPPPSLHYSLHLFEGMKAFKRQYDQAMVRLFHAWLNMDRMLRSSMRLCLPSFDKLYLLECIRRLIEDDKDWVLDAASTSLYVRQ

SEQ ID NO: 787778 - protein, 178 aa, Homo sapiens
MPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFKRQYDQAMVRLFHAWLNMDRMLRSSMRLCLPSFDKLYLLECIRRLIEVMKDWVLDAASTSLYVRQ

SEQ ID NO: 787779 - protein, 273 aa, Homo sapiens
MSGSLRGSLCGPSRGARVAHRVARWCGSGCGAWLWFIVWLLVPALGGAICLVNSDNERDSGMLTSYATPERSASPNFLEGQVAFSHPRLSNNRSVMPLDVRGCTRATLTGSACAYPTPAGAGNPLNPIRDGDRGLQLFPMNEEFPVSAGHKLALIKSLPFVHTARRYYRLDGLVRPAPNSALPEPHAATQPPPSLHYSLHLFEGMKAFKRQYDQAMVRLFHAWLNMDRMLRSSMRLCLPSFDKLYLLECIRRLIEVMKDWVLDAASTSLYVRQ

SEQ ID NO: 787780 - protein, 178 aa, Homo sapiens; identical to SEQ ID NO: 787778

SEQ ID NO: 787781 - protein, 125 aa, Homo sapiens [sequence omitted]

SEQ ID NO: 787782 - protein, 70 aa, Homo sapiens
ILLCCHSQTDNPKCQSPCGANRILIRCWWEWKMVQLLGKIGWQYLSKLNKHLPCDPAIPPPDRYTTEMHP

SEQ ID NO: 787783 - protein, 69 aa, Homo sapiens
MGFWKWVGGPGRASPSPLGEGLCAEGCPQRPGYQEHCSRQGAFLPDLAERKEDLVSFSTQPSGPYRAAP

SEQ ID NO: 787784 - protein, 119 aa, Homo sapiens
TRPPTRPGPKPPSMRRHDSGRRGAGRYHLGPSSSLSPNLQHPGLPSWRAAARLLQREAEGSVDQERLLFTYRWCRAKQPEGPGLPAPAPPRVGSASVHRAGVRTHPRYFSGLCFPSPQM

SEQ ID NO: 787785 - protein, 130 aa, Homo sapiens
TSDFIAAGWTAPSRRRSPFSPSQLSVWKTGEAGAPRHCPQDRPPGTARKRPWPVRWPFPALDRLWRGCRRRLGLGVLEGSLGCGGARRPPGDLGREAPGLSLALQTHGLGSNASSTTSWLCGLGHVSYPL

SEQ ID NO: 787786 - protein, 105 aa, Homo sapiens [sequence omitted]

SEQ ID NO: 787787 - protein, 37 aa, Homo sapiens
GDHAGKGVLVLFRAATENRAPNQLCSLVPSLLWASDS

SEQ ID NO: 787788 - protein, 477 aa, Homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 787789 - protein, 186 aa, Homo sapiens
ASAAGPRGRGLEGSLGMLRAEKALWFLLPHTSPSPPLFPGTSEVAGKWEGRRACRPCRLGSRSSGVGGVRVRTEARGRDGRGRGKGGRHWGGLGCGAGDSPFPSERRGGPLPRGTPTQPFPTSRTKGLGSTVGVGERRWREAGRQAVGAGEGASPRFLSRPNDGKLPPANASLRPLLNPGGFGFVT

SEQ ID NO: 787790 - protein, 79 aa, Homo sapiens
MMLVAVWEALLGLHVPWSQQGLEAGRSPTLLGTAAATQVAAADLGISALSGAWEGSRAPAGSGCLLPMSGLSLLLVPAL

SEQ ID NO: 787791 - protein, 123 aa, Homo sapiens [sequence omitted]

SEQ ID NO: 787792 - protein, 362 aa, Homo sapiens
LTGALKSSPPLHYLSSWQRITIASRSMPDGPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSGGKARKRDD

SEQ ID NO: 787793 - protein, 110 aa, Homo sapiens
MDDEAETRDLIMGFNCSLQVDKIFLGEVNWMSFCASQQLQVLSLASLGSSALRGLWHDGSSQQGLQRSPLGEIYRAQCAWSPGFLQDCYCIPIEWWFALHRALTWDSYLL

SEQ ID NO: 787794 - protein, 91 aa, Homo sapiens
IEKEEKGKEPGEKSAAMPSRPSSSEDSLMSRASCSPAPGLGVLLEKGEKQSLLPHRIDDHNDHRYLSLRPSLVAFDCHHPLNWAQLQPSCH

SEQ ID NO: 787795 - protein, 463 aa, Homo sapiens
GTRTRRLFQKKETAMAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVETCGTDDLGETPRYPKKPLQKNSSVPFGSKADTVTTV

SEQ ID NO: 787796 - protein, 667 aa, Homo sapiens
GTRTRRLFQKKETAMAAEASKTGPSRSSYQRMGRKSQPWGAAEIQCTRCGRRVSRSSGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKDLI

SEQ ID NO: 787797 - protein, 657 aa, Homo sapiens
GLALGGCSRRKRQRWRQRLRRLGLLGLPTSEWGGRVSPGVPLKSSAPGHHCELQCGHAFCELCLLMTEECTTIICPDCEVATAVNTRQRYYPMAGYIKEDSIMEKLQPKTIKNCSQDFKKTADQLTTGLERSASTDKTLLNSSAVMLDTNTAEEIDEALNTAHHSFEQLSIAGKALEHMQKQTIEERERVIEVVEKQFDQLLAFFDSRKKNLCEEFARTTDDYLSNLIKAKSYIEEKKNNLNAAMNIARALQLSPSLRTYCDLNQIIRTLQLTSDSELAQVSSPQLRNPPRLSVNCSEIICMFNNMGKIEFRDSTKCYPQENEIRQNVQKKYNNKKELSCYDTYPPLEKKKVDMSVLTSEAPPPPLQPETNDVHLEAKNFQPQKDVATASPKTIAVLPQMGSSPDVIIEEIIEDNVESSAELVFVSHVIDPCHFYIRKYSQIKDAKVLEKKVNEFCNRSSHLDPSDILELGARIFVSSIKNGMWCRGTITELIPIEGRNTRKPCSPTRLFVHEVALIQIFMVDFGNSEVLIVTGVVDTHVRPEHSAKQHIALNDLCLVLRKSEPYTEGLLKDIQPLAQPCSLKDIVPQNSNEGWEEEAKVEFLKMVNNKAVSMKVFREEDGVLIVDLQKPPPNKISSDMPVSLRDALVFMELAKDLI

SEQ ID NO: 787798 - protein, 76 aa, Homo sapiens
LRERKRHGRASAARLAGRSRALHQRCSRLVAGGSYEDLRFKTRLSRELAWYPLANHFSEASVSSSVNVNIPSFFFA

SEQ ID NO: 787799 - protein, 70 aa, Homo sapiens
DSSEGGEVHVPKSPDGPETMKMLYREVTKSLHVSRGFVELEKGLVNALALSQQGFPEGVFSTRMTRQTPA

SEQ ID NO: 787800 - protein, 83 aa, Homo sapiens
RRGPKRLHSAHTCEAGRADINIGHGFRQGECQGLHGLHCKGLQGGQKEVQHPGKTSLKRGSQPSPRCPPRFPRSWGLGRLGSL

SEQ ID NO: 787801 - protein, 73 aa, Homo sapiens
MDGKLQKTDILIYEVPQIPEQAVEPASPRGPPLSFCKLHFLGFCKLHFLGFCKLHFLGFCKLHFLSFCKLHFL

SEQ ID NO: 787802 - protein, 105 aa, Homo sapiens
MDTEGQEKLSHGHPSTSRLYPCLPNPPPAPLRVKQSYPHSSTNCSQACLWPAAKPSESPFASLGLSFLICKMKGRAWRVPGALCSSSIRTEEAAGLSGGGNFPDH

SEQ ID NO: 787803 - protein, 53 aa, Homo sapiens
LEVVPPAEANASQHPEANEGQHPWDQSPKSSRIRMQEASIYQRFYSEKADGRS

SEQ ID NO: 787804 - protein, 40 aa, Homo sapiens
CRHLMEDSMGMYVDMSPLRPQNYLFGCELKADKDYHFKVD

SEQ ID NO: 787805 - protein, 157 aa, Homo sapiens
MEKTQQAEGNIEVEKTQQAEGDIEVEKTQQAEGDIEVEKTQQAEGDIEVEKTQQAEGDIEVEKTQQTEGDIEVEKTQQAEGDIEVEKTQQAEGDIEVEKTQQAEGDIEVEKTQQSGGRHRGAEASRRHRREDEKGSSPLTFCLFASIFIVRFFTVIL

SEQ ID NO: 787806 - protein, 130 aa, Homo sapiens
LGNRETPVSTKNTKICWGWWQCTFSPRYSLDIEVEKTQQTEGDIEVEKTQQAEGDIEVEKTQQAEGDIEVEKTQQAEGDIEVEKTQQSGGRHRGAEASRRHRREDEKGSSPLTFCLFASIFIVRFFTVIL

SEQ ID NO: 787807 - protein, 243 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTWDEYRNRGFGGPQTEKNPQTHNKQTKGHLKGAKRKDSFHTERQDGPVQRTVMSGPVILFKGKHICRSATLAGWGELYGRSGYNYFFSGGADDAWADVEDVTEEDCALEVVNTHLIDKVRGYDIKLLRYLGQNKYTLVTLM

SEQ ID NO: 787808 - protein, 219 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVHGDAKLQELIHLQQDGPVQRTVMSGPVILFKGKHICRSATLAGWGELYGRSGYNYFFSGGADDAWADVEDVTEEDCALEVVNTHLIDKVRGYDIKLLRYLGQNKYTLVTLM

SEQ ID NO: 787809 - protein, 103 aa, Homo sapiens
SAVEAIQAISAHWNFHFPDSSNSQASASRVAGITGTRHHDWLIFLFLVETEFCHVGQPNLELPTSGDPPALASQSARITGMSHHAQPIHFHQYFKAVDLALSI

SEQ ID NO: 787810 - protein, 33 aa, Homo sapiens
MTDLDYTGKMNSHEDTGKDEDDNSYGNKGEQTK

SEQ ID NO: 787811 - protein, 83 aa, Homo sapiens
ERFGAGPRGIQPGTGGDPRTLRKLPPISLSSEPLAQHRPETPASKMKAIFCLWTEYPTKDLILKAMEHVYPHGSSGQTGGETV

SEQ ID NO: 787812 - protein, 110 aa, Homo sapiens
LFRLVSGMEQGLELRSLWLEIGIYSFLTLEPTYPSVTCQTPHLTHSHLQQSFLNSIKHQNSLHCFLKHDRRPFPSLRLLDSMDQGCGLRMCISNKTLGKSPAAAPCWTML

SEQ ID NO: 787813 - protein, 85 aa, Homo sapiens
DGSGDGSGDDSDDNGDDGGDDGDGGDDGDGDDGGSDGGDGNGSGNGGDDGDDNGDDGGDDDVMVVMMVMVMMVAVMVVMAMVVAM

SEQ ID NO: 787814 - protein, 66 aa, Homo sapiens
TDDDQTPLAPALEGLWAAGDAHQALWHLALSGPCSGLLALSIKASALGKGCRILENPLFQSDLNHT

SEQ ID NO: 787815 - protein, 148 aa, Homo sapiens [sequence omitted]

SEQ ID NO: 787816 - protein, 451 aa, Homo sapiens
SQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 787817 - protein, 107 aa, Homo sapiens
MDFVLDSFLRLFSGFSVLLSLGYLSSFLWVRSLFSGCTVIFCSLVTLSIKVPSFKDITTFNICNDCGEFMNEHLYSQSFGCSSTLFRYCMSTGSVVTSKVSLYSALQ

SEQ ID NO: 787818 - protein, 167 aa, Homo sapiens
MGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTP

SEQ ID NO: 787819 - protein, 88 aa, Homo sapiens
QSSPLCHRPCAHNPAFHAASFVLKTSPRGGLQSVAAGRKARGPAGGSWEELVHTHLVLVRKENCKSQKVNCSTHEGIDESVQESWTSF

SEQ ID NO: 787820 - protein, 63 aa, Homo sapiens
LFLLLECHVGVDQGFPSLSHLSSTCFRKNTLEFRSESIFTSESVFALSSFFPPMLPKHKMVYF

SEQ ID NO: 787821 - protein, 88 aa, Homo sapiens
SGTCPAAPRSPALRDCKAEPLGSRYHPLQPATNICAVGQEEKWRPICHVPKYLKVINSAAKVCSILTLPIILAKLWRSYDQMSAKHQK

SEQ ID NO: 787822 - protein, 65 aa, Homo sapiens
MCQVEFELAHTALKQLKGTVCDQETAGVQLLQTAHPERLQHPCPFSLRCESQGQVGGMECEQRDV

SEQ ID NO: 787823 - protein, 238 aa, Homo sapiens
MTLRLMNSLAKRILDVEDRKSLWGQADLDSNTSQFCLLCLSLSLLICEEEVARMKMPALWFVVRTDTANVEGPAAHRPVALRADHSCLDGRELFLCVASGTLGRKATVRLLRRTLHKGVSSQGRGMERVAEAYGKGSQGSARECHHPSWGMQGKVPGGSFPGKPKKRPTKTESTFGYLWYPEAAMPTTTTLEEEDLLRIDSLISSSFMAPALGNQHGGEIMKLEYNHLQTSQPPPVDT

SEQ ID NO: 787824 - protein, 57 aa, Homo sapiens
MAEAPGPSGESRGHSATQLPAEKTVGGPSRGCSSSVLRVSQLVLQAISTHKGLTLAA

SEQ ID NO: 787825 - protein, 102 aa, Homo sapiens
TELPLPVDAFQHHMNVHLKESVKYLKYLYLLFVYFSKWVFIFNEIIFNFSKNTLKISIDNAYLTFFWLSPFFSFQGVLLLRNHFYGCGDNCFPASFNSRSFC

SEQ ID NO: 787826 - protein, 74 aa, Homo sapiens
TAVQLVAEVDSYRILKLLPLNGFGTFVKNHLTMHARFYFWALYSTSLVYMSLFMLLPYGFDYHSFIDKTDNWTS

SEQ ID NO: 787827 - protein, 127 aa, Homo sapiens [sequence omitted]

SEQ ID NO: 787828 - protein, 109 aa, Homo sapiens
MSSSLIHFQRLYLLKCSSYLLMDELKHPYVLSSCCLTTRKGVANADPKYKHILASNDHLFSTEVVNLWMLWPNVALLEALRKAQKPRTDEMAAPHQDLFFFLDFFFLCL

SEQ ID NO: 787829 - protein, 101 aa, Homo sapiens
DSSGTLAIKLPESAAAEAAAASKEADDAQCKDGFSEQPVGQDNVFHQMSLDLEEVSPVYPVVVFLLINIKGGEKVCIGVSAENKSSKHTKWNLLIALLLTQ

SEQ ID NO: 787830 - protein, 47 aa, Homo sapiens
RRKKWLAVLAKKELRYEISFSNYALTTRKTSVTKCVFFLHSPSNSTA

SEQ ID NO: 787831 - protein, 78 aa, Homo sapiens
KSTIIFATDTPLHLHFNSYMMRKYRFPYPAAMKERESKLGGPLIFHECQVEHPNLENIQEIMSKEYNLNSLVLKTFKK

SEQ ID NO: 787832 - protein, 118 aa, Homo sapiens
MAALEGVGRTAKVDSASNAVKTALCLMESGACYGKQSQLLRGCLEGCPAPGLVLTSDGGGSTCSLVIQLRPDGARVRAGCSNNLLDEQGCNNLLGEGHLHMTCGHASPIFHGGWGYKL

SEQ ID NO: 787833 - protein, 53 aa, Homo sapiens
MEEEEEKKEEEEEEEKEEEEEKEEEAEEEKAEEEEEEEEGAEEEAEEEEEDPA

SEQ ID NO: 787834 - protein, 102 aa, Homo sapiens
WDYRHTPPCLANFCIFCRCSLAMHVAQAGLELLASSDPHSSDSQSAGITGMSHGTGPTTFETYIIIYLPSTDVETGTERLSNLSNVPQPVQGWAKFEHRAVP

SEQ ID NO: 787835 - protein, 121 aa, Homo sapiens
SALLSQGSKAATLPHDTLDPHFKPSSPISLPNSLDSQLITLCRSTADHQLCLLQKCKDTLSTRDLALATTHEDPWQSIRADPWGLASFLNSSHPLTLLLLVSTTLISKLTRGLGFGSDHLA

SEQ ID NO: 787836 - protein, 190 aa, Homo sapiens
VWTAERISSDVIELQAVHKEIRITEMLPVEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVCSQKYNRN

SEQ ID NO: 787837 - protein, 54 aa, Homo sapiens
QTLCDNNPSCRQKQRSHEAQHASFQVNWRQCVPQQRQRLLIVGADCMHVGYGAG

SEQ ID NO: 787838 - protein, 32 aa, Homo sapiens
MLESVVQNGCHWAKIKVSLLQYEEPPQRGGFP

SEQ ID NO: 787839 - protein, 91 aa, Homo sapiens
LAPGSSSCSGGASGEDSQVATAALPAPVGALSPRGMGLKCSGIAVRLSWDLSPCPHWQVEECWYADPGCPFAMHSPMGREWCWYISRYTPQ

SEQ ID NO: 787840 - protein, 70 aa, Homo sapiens
VSDIQPGSDPTKPDATLVVKNHQLIVTRGSQKDYRKDVSIGTKVVCWFVHNNGEGLIDGVHTDYIVPNLF

SEQ ID NO: 787841 - protein, 113 aa, Homo sapiens
MFKRKLSRNYCFRERSSRTGHWQPLWGTGDEAAWGCREDTFPSWSLMMVRVSSQGHCHQGKVSPQHAWQPGHSPASGTVRQHSSGTSGKEQRLERESMADLSVNPLRATLWSF

SEQ ID NO: 787842 - protein, 80 aa, Homo sapiens
SFLADYFCEQLGLSVLWEHPGKQCGYDLELLTSSSHSVVESCSLWMLILLYFRFSTGVGPISSGHLRKPSGKESQVKASS

SEQ ID NO: 787843 - protein, 80 aa, Homo sapiens; identical to SEQ ID NO: 787842

SEQ ID NO: 787844 - protein, 80 aa, Homo sapiens; identical to SEQ ID NO: 787842

SEQ ID NO: 787845 - protein, 252 aa, Homo sapiens
AKHQMADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSAGAALHPGQLRKAPLMPFLRLQY

SEQ ID NO: 787846 - protein, 232 aa, Homo sapiens
RAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLTLAGTLHCNCELLWLRRLARPDDLETCASPPGLAGRYFWAVPEGEFSCEPPLIARHTQRLWVLEGQRATLRCRALGDPAPTMHWVGPDDRLV

SEQ ID NO: 787847 - protein, 50 aa, Homo sapiens
NTRSSFLLPQHEKQKDKQHIRVPILISATEGQEGACNSFQKELIQLQRNN

SEQ ID NO: 787848 - protein, 159 aa, Homo sapiens
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLVSKHSLTCLLQLLL

SEQ ID NO: 787849 - protein, 218 aa, Homo sapiens
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEADKYHPLFYFFQGIVITPLLLLLFLGSSSSVPFTSIFSQLFMTVVVPLIIGQIVRRYIKDWLERKKPPFGAISSSVLLMIIYTTFC

SEQ ID NO: 787850 - protein, 148 aa, Homo sapiens
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEQLQYFNSAFGSFWASL

SEQ ID NO: 787851 - protein, 169 aa, Homo sapiens
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEDPPCLVSFLELSWEEISLKQQSSQMSGSERVPEARLW

SEQ ID NO: 787852 - protein, 230 aa, Homo sapiens
DLGIVHPDLKPEICCTTAWMKTPKSLRLWPLPRWTRAALHRLWGIAPEVLAQKPYTKLWMLVHRCHRLHLALRYPPFYDENDAKLFDQILKAEGPGLTLLTGTTSLTSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 787853 - protein, 44 aa, Homo sapiens
GPQGSPFMLGGGFFHTSQTQLSGFLTQKNFHAEGSENSALHFLR

SEQ ID NO: 787854 - protein, 66 aa, Homo sapiens
SGEKEVKRARAPGKRPGSDQGFCQNRKVEEPTTRGVLLIRKRHSRGRSGKVRMGDSGSLRQGSEST

SEQ ID NO: 787855 - protein, 148 aa, Homo sapiens
QRIFTTSYDPYQRADSINFISRLLPAQLFPRELHSPEFEFQATIQNSKYPQRGNSEVNRSHLQRVTKDALAMTQEISHCLDSSLQSQPVGLPRAMRRKWARKESIIATHRCACECYKGNDREHLGEVLRTRSQSSMLEQVLVLPGTNF

SEQ ID NO: 787856 - protein, 35 aa, Homo sapiens
GVAPGRGGVAPSPSPGQWAGGEKWRGRRIIPSQGG

SEQ ID NO: 787857 - protein, 107 aa, Homo sapiens
TEQDDLFGRSFSKKKMKIINIRMHFILTVTKIQGHETFSLETICKFLFENVIFIDFISKTLQKNAKYQKILQENGNYPNPTTQTLLVFTFFPHCLTSILSTIVRAPR

SEQ ID NO: 787858 - protein, 72 aa, Homo sapiens
QILILRTGVELKYLSPELVFQGLNYESNSSFKALIIFRLLLQLLHNLCVQPLLSGWHLLISTSELAEVAPDV

SEQ ID NO: 787859 - protein, 135 aa, Homo sapiens
MRGAGRSRAWWAAGWQGTWSAAAGPRGGGAAAAAAPASPSSDRLVGFSLAGSALAGCSPGTSAARARPASSLASSYIRRPRLREPPGLRSPPRGPSSTLSQGSCSPSEQPRSILRPPGPRHRPCCSQSQAATPRP

SEQ ID NO: 787860 - protein, 114 aa, Homo sapiens
MRGAGRSRAWWAAGWQGTWSAAAGPRGGGAAAAAAPASPSSDRLVGFSLAGSALAGCSPGTSAARARPASSLASSYIRRPRLREPPGLRSPPRGPSSTLSQGSAASPRQRPRGR

SEQ ID NO: 787861 - protein, 68 aa, Homo sapiens
PGLRFPPPWAPRPPVVSKSPPPVAHGLTGVAVSRLPSIISSRDNGRGWGGATGKDGGCRAGATATWDV

SEQ ID NO: 787862 - protein, 38 aa, Homo sapiens
MASGVGHDETPAPEGPACTSSTSLDAVNPLCSSSRYRE

SEQ ID NO: 787863 - protein, 74 aa, Homo sapiens
EVKGLGRVKLSQGGGFATSPGRTQEEAVKATPFLCPLAQVAGPSVPLQVGKQLSFPAQNLGQPGSSLDPAWTLM

SEQ ID NO: 787864 - protein, 122 aa, Homo sapiens
ASFPALQDSLIQRFPSGAPEPGPLPHTWDSPAGLVCFQGGRRKGVASPFWQESRSLGEKRAQANTTDSPTRKYEIADLCQQRLISTSWIPGSGLSYCLLESHEETVEAEVRGQRSGQAQSHS

SEQ ID NO: 787865 - protein, 99 aa, Homo sapiens
QPFDIFVLRAEDGCISTKELGKVKKETVKEKASRKERTKEVVEEEENGAEEEEAETAEAEQAGRSRGKKKHAEDASRRLMKGPRVKRAAEGPRGGSDEK

SEQ ID NO: 787866 - protein, 111 aa, Homo sapiens
LRSCTRLPSWSFDSWPTVRRARAVRRPTIRRRISASFSIWPTPTMLGTDLHMYDTKMYADGLSPELTVAFTGSTLDNLGPIARPPWRRRPIRTSALSTFDGSRRAYHGDHG

SEQ ID NO: 787867 - protein, 154 aa, Homo sapiens
APSLSSDIAIIGTSLFIGTPDRSTEIGKLLSSYLQKTSDVEDHSVHLLKTANRWEQVPLIKEKLSQGVTLVVDRYAFSGVAFTGADEYRSLFIGIKTNPVSPSPAPAGGRAPAALVTLDNLGPIARPPWRRRPIRTSALSTFDGSRRAYHGDHG

SEQ ID NO: 787868 - protein, 111 aa, Homo sapiens; identical to SEQ ID NO: 787866

SEQ ID NO: 787869 - protein, 67 aa, Homo sapiens
MAPQPSSIATIVLNLRGSEARIRLSVVLESLDNLGPIARPPWRRRPIRTSALSTFDGSRRAYHGDHG

SEQ ID NO: 787870 - protein, 41 aa, Homo sapiens
MMTEDYLRVRSSKKTGPCEGRSKVDELRYASNSVAEYNGGS

SEQ ID NO: 787871 - protein, 106 aa, Homo sapiens
HPGALLQKQIVNIDRITKYMSRVHGMHPKETTRQLSLAVKDGLIVETLTVGCKGSKAGIEQEGYWLPEVRLGAHPRRTSRRGSLRNGYHIQGRQQARKLPTPDPGR

SEQ ID NO: 787872 - protein, 179 aa, Homo sapiens
EARGCVLSIAWPWRDSSDATARMQLSHQGKAGSPAGPWVVSFDFPGEGSEWERDQTWASQASTERSVKSRSLGPKREPCLVLPMPPSWKSPRRIHVWPCLWGKGVGEMFPADHPPLHLGGDTAEKNRLCSRAPCLVPGGALLGIITITSFSPPPPPPSPTALDCWDTREYDRAVARAMA

SEQ ID NO: 787873 - protein, 118 aa, Homo sapiens
LLAEGWWPPLGVGGLCAPHLHCTVPSSLASNSTTETGAPDTEACMLVHRQAGAVPSGRQGQIPHQVRSALSLTPCPSSHPGQVQASCILPLLPLLPGLGSTRVGGRLVGWPSPLSCSF

SEQ ID NO: 787874 - protein, 257 aa, Homo sapiens
LKRKVAEQEERQGMKVQALARENEVLKVQLKKYVGAVQMLKREGQTAEVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQVYIRIKDDEWNIYRRYTEFRSLHHKLQNKYPQVRAYNFPPKKAIGNKDAKFVEERRKQLQNYLRSVMNVQMVPRVAASQKETLIQLMPF

SEQ ID NO: 787875 - protein, 139 aa, Homo sapiens
MSPAVVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQLFKNVKIILSLWAV

SEQ ID NO: 787876 - protein, 214 aa, Homo sapiens
MSPAVVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQVYIRIKDDEWNIYRRYTEFRSLHHKLQNKYPQVRAYNFPPKKAIGNKDAKFVEERRKQLQNYLRSVMNVQMVPRVAASQKETLIQLMPF

SEQ ID NO: 787877 - protein, 62 aa, Homo sapiens
MKAAPSSPSPPATSSAAQASLDHARLYTDVFCPTHASRHRGETLEGEGTADEGNEKSFAHKE

SEQ ID NO: 787878 - protein, 1289 aa, Homo sapiens
AEAFPAMWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCRGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQETALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 787879 - protein, 182 aa, Homo sapiens
AEAFPAMWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRAVILFADLEKKCYRSKLRGWE

SEQ ID NO: 787880 - protein, 904 aa, Homo sapiens
AEAFPAMWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCRGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGKFSF

SEQ ID NO: 787881 - protein, 156 aa, Homo sapiens
TGTAKGFATVLAEAVTSLDLPVAIINLKEYDPDDHLIEEVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEELVVRTIRA

SEQ ID NO: 787882 - protein, 234 aa, Homo sapiens
MANETQKVGAIHFPFPFTPYSIQEDFMAELYRVLEAGKIGIFESPTGTGKSLSLICGALSWLRDFEQKKREEEVQVLAPAFLWVIPHTATRHRGGGDPGMGDSPFVRSPRLSCFAPCCLLRAAQCDWRWWVGERCQSLFLCWMMGQVNALSAVSYSTPASPVFGPSLALPGHVIPPDNILPLVICSGVSNQPLEFTFQKRDLPQMVIPASSLHHSLASGSQRVTWGTGRSGPNL

SEQ ID NO: 787883 - protein, 249 aa, Homo sapiens
GGCSGSLSLRGPASFKFSGVCPDSRGLAFSVAILPAKKEDFMAELYRVLEAGKIGIFESPTGTGKSLSLICGALSWLRDFEQKKREEEVQVLAPAFLWVIPHTATRHRGGGDPGMGDSPFVRSPRLSCFAPCCLLRAAQCDWRWWVGERCQSLFLCWMMGQVNALSAVSYSTPASPVFGPSLALPGHVIPPDNILPLVICSGVSNQPLEFTFQKRDLPQMVIPASSLHHSLASGSQRVTWGTGRSGPNL

SEQ ID NO: 787884 - protein, 35 aa, Homo sapiens
MHNSGRAWAKELDDKLPAVPRGRRHEPFWRRKADV

SEQ ID NO: 787885 - protein, 79 aa, Homo sapiens
MHPEPCTLELDGMGCRGRKGAAEAGRGYAGWKGAAETGRGQQRQEGGCRLRSQAEGAGGNKSMGREASWRQGHPGSPGQ

SEQ ID NO: 787886 - protein, 62 aa, Homo sapiens
MSSISLSLLYEEKERVLDPELFQESLHWLHSQSGKANCVQSIALTSASSALPPRFTNSFFVP

SEQ ID NO: 787887 - protein, 71 aa, Homo sapiens
MVGFWQKTLNDPFKRRQRDGWRPGKAGKGSPNKEEIRGLVEPLEYRLRSQETGQLIFIWVALESCLTYLCL

SEQ ID NO: 787888 - protein, 68 aa, Homo sapiens
LLVVPLSSNLISVLSYLANDMEEDDEAPKQNIFYFLYEETRSHIPLLSELWFQLCRYMNPRVYEELLS

SEQ ID NO: 787889 - protein, 463 aa, Homo sapiens
MHSASSMLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 787890 - protein, 457 aa, Homo sapiens
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 787891 - protein, 354 aa, Homo sapiens
MHSASSMLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASEIGDEWLMRAPGRDSEGGDKAAAGRPKGPGKGGTRHTGARKETHPNLGPPTYL

SEQ ID NO: 787892 - protein, 343 aa, Homo sapiens
PLGCESARDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASEIGDEWLMRAPGRDSEGGDKAAAGRPKGPGKGGTRHTGARKETHPNLGPPTYL

SEQ ID NO: 787893 - protein, 32 aa, Homo sapiens
MPPFRGHLAGEARHGHTVSTRNEQGSVIAIPR

SEQ ID NO: 787894 - protein, 241 aa, Homo sapiens
MCSQLWFLTDRRIREDYPQVQILRALRQRCSEQDVRFRAVLMDQIAVTIVGGHLGFSWNEPGPKIYLWRREMKSWPPAKPEGPHHFPGCGACTGTHTLSAVNSDITVLRHLEKLGCRLVNRPQSILNCINKFWTFQELAGHGVPMPDTFSYGGHEDFSKMIDEAEPLGYPVVVKSTRGHRGKAVFLARDKHHLSDICHLIRHDVPYLFQKYVKESHGKDIRVVVVGGQVIGSMLRCSTDGR

SEQ ID NO: 787895 - protein, 142 aa, Homo sapiens
MQFKMQMMEADYVWEMLSNSDPSFLSSELYVKSTYSESTPELEGIYHLRGLNLLFFKQELGCGGACPRQEGKTRSLMLSGAKQKQQPATKSISRWIHLHNHRPLPIPHARCSTRACPCEISEHTEASISFPLSCVLSTELTH

SEQ ID NO: 787896 - protein, 195 aa, Homo sapiens
PESQRQRTVLNVTDEYDLLDDGGDAVFSQLTEKDVNCLEPWLIKEMDACLSDIWLHKDIDAFAQVFHLILTENVSVDYRHSETSATALMVAAGRGFASQVEQLISMGANVHSKASNGWMALDWAKHFGQTEIVDLLESYSATLEFGNLDESSLVQTNGSDLSAEDRELLKAYHHSFDDEKVDLDLIMHLLYNICH

SEQ ID NO: 787897 - protein, 122 aa, Homo sapiens
LTRPVGSTISNLLPSSHNCKTPKPELNMLLCSLHPPIFQPNSTSISEEQQTLIVTAISYWPQHNFQIGNFPPVYLHHIKTCGNVKTQASFQSDKCRLPRDPNRNLFRTFFFLSDKIKQLIDH

SEQ ID NO: 787898 - protein, 30 aa, Homo sapiens
MAQHTALSLACRALACPKSWRPRDKHSPAA

SEQ ID NO: 787899 - protein, 60 aa, Homo sapiens
RQPGNTIGQCHALTCSDSPTRQIVRVPMKICSPAPTPASAPLRTSLLVGLFYKLPSQLIL

SEQ ID NO: 787900 - protein, 147 aa, Homo sapiens
MAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSV

SEQ ID NO: 787901 - protein, 204 aa, Homo sapiens
LEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSV

SEQ ID NO: 787902 - protein, 69 aa, Homo sapiens
SPHRAPESDPCAVHGTVHHTRGSRARPPHAHSAVHHRMWLLSLRRSVVARTATMSLQAARYPSPGLEPV

SEQ ID NO: 787903 - protein, 169 aa, Homo sapiens
SAWVVWPVGSRRPGGSSLGVCEGLGNVGIGVGPAGVFIPSPSGAASLLGWIQTSAPQPRTTASQALIVHPQEGARRASRRWLSRLSPSALIEKCSHSSTQGRRRKPARGWGKHVCLSKAGLPGRVTRLTLLPGCRWWWHGPPVSCLGSGLCSDLPLAVSAPSLRSLAAS

SEQ ID NO: 787904 - protein, 106 aa, Homo sapiens
MRSLAVQLLLPRRCLWSLRCLCNPVQSDFHAFMWSPGLPARRVNPRRDTRSHVGRLGTGPPCTCVEFCWSPSLTLSPRLEHNGVISAICNLCSRVQATLLPHHTPN

SEQ ID NO: 787905 - protein, 106 aa, Homo sapiens; identical to SEQ ID NO: 787904

SEQ ID NO: 787906 - protein, 52 aa, Homo sapiens
GVDFFFLALTPCGGTEFKVPSWKQKQGPTPDMKPAGTLILDFPFSRPGRKDI

SEQ ID NO: 787907 - protein, 157 aa, Homo sapiens
KYTIKPPRDLCSRFEQEQEVKKQQEIRAQEKKRREEEERLMEAEKAKPDALHGLRVHSWVLVLSGKREVPENFFIDPFTGHSYSTQDEHFLGIESLWNHKNYWINMQDCWNCCKVPREGELGGCGRHSAGDRNRGKQWQPDLGESETPGHEGFEPSP

SEQ ID NO: 787908 - protein, 94 aa, Homo sapiens
MVSKSSRTSAGRPWATRARASPNTSSVCPRHTRCSSWRRRAAGYLSWARRSQASTSRPSSPSLSCAWLHCASSASSRQPKPSVWLEPASSSSTA

SEQ ID NO: 787909 - protein, 59 aa, Homo sapiens
RKFLNIFIVLKNECNGVGIRKANIRCPLLWFCFLNGDKRSHSVCKNSFLLGCSGYFIPD

SEQ ID NO: 787910 - protein, 136 aa, Homo sapiens
SKPNTKLEEIIKIRAEINKFETKKYKRSMKQRVGVLNQMKSEKRETRFKEIVSDMKKETLNQHHRTSKDHYRLPRATAHRLENLEEMDEFLYTHNLPRPDGFTAEFYQTPNNYIYTSVKFNELDQQRSTEMSEKQC

SEQ ID NO: 787911 - protein, 71 aa, Homo sapiens
LVMEKRKCHPYKMNLHSEPQEVLHVGSAYNPSTMLFTASPASSTVPGVIQTSTVTQLASLLLKTSPTSTIL

SEQ ID NO: 787912 - protein, 75 aa, Homo sapiens
ERENAQSRGGRGLGGGSSGGGRIEHTVLEATVGLGIIDHQSNGSLFRTALEEEQDNEICTPAAGWGGQCGGGGGQ

SEQ ID NO: 787913 - protein, 68 aa, Homo sapiens
EAEVAVSRDRAIALQPGQQSETPSQKTTTTKYVMRKLIELQGEIDEFTVCSWRSSTLYRKWTDPAGCS

SEQ ID NO: 787914 - protein, 126 aa, Homo sapiens
NRDVQGEETNDLWSLIYKCKQYLTNPQVLNYQTCFNLLMQTVPNKPTGPKLTREETVMLCGLCIQTFRKYCRQSWGFRGQSIFGEPRTHQRASLVFSNLHCISEVYKGKGQESSVPVRQLLFSSGF

SEQ ID NO: 787915 - protein, 31 aa, Homo sapiens
MSSELLQEYTVLAPNRYGAGVPTLEIRTSVV

SEQ ID NO: 787916 - protein, 132 aa, Homo sapiens
EQTTEFGIHKPHLGKSSSLDKQLPGPSGGEEEKPMGNGSPSPPPGTSLDNPVPSPSPSEIFPVTHSFPSSAHSDTHHTSTAESQKKATAEGSAGRVENFGKRKPLLQAWVSPSETHPVSAQPGAGTGSAKHR

SEQ ID NO: 787917 - protein, 35 aa, Homo sapiens
MSKGKPQTTKNISYSAPHRMQCEIDTRGTSTLAVF

SEQ ID NO: 787918 - protein, 90 aa, Homo sapiens
APVPTQDEDPLLSFPHPGPPPSVFPHSQTAVPSTPRWACWAAGPEFLGSPSLPPSLLRDPGAPCGKCPGDGAVECQPGVLSCTLCPRIQE

SEQ ID NO: 787919 - protein, 113 aa, Homo sapiens
CSFHCYTIPLRSIATNQILLQAPDYTVAKLYNLLECSIPFSWVTSLSGACCNYSPATDLQERRITGQILRKTVPCWATTQREANYRFFRQTEIKFLWEGLERLLLRERQQSSI

SEQ ID NO: 787920 - protein, 47 aa, Homo sapiens
TVGRDRSPERGETVQREGEFGVILQMSTKAREALLCVRHCVKVVGTV

SEQ ID NO: 787921 - protein, 105 aa, Homo sapiens
PPPSLPQIMALKEKTSCFSNSRDTTAGGAVAGLGTFSTQEAGYGKSLPCISCNTKEDGCLGLPCLLAIKEMATAKQCEVTAPESFLHQRLRTGAVQSYSILSPQP

SEQ ID NO: 787922 - protein, 144 aa, Homo sapiens
MASLACSLLQEAARCQPRPNAPASDHPSPELAACQGGTPPRPRGNLNPGPEQHRPPSLQSICGHGGPGERVGDSYSGCLGPPEVGAGVLQQLGENLQAAGPLPPLQGRRQVFALKVLQVGVGEGPAEGSWEAAPELDKLSEYQA

SEQ ID NO: 787923 - protein, 81 aa, Homo sapiens
MMMEVVIVKTKMGICREQEREIRLLLCLPQTGEDIRELHFDKTTVLVTNCFAEMSLICTFAPALCPSNLTNLELKKPVLYE

SEQ ID NO: 787924 - protein, 41 aa, Homo sapiens
MFKYMALYSMIQYVGVLLLYWETNSLSNYQFLFQDLAITTL

SEQ ID NO: 787925 - protein, 80 aa, Homo sapiens
MRSLLIRVPPGARDPQREESSKTSPRAFARTNPVPAPAPERLRNSGHSESAGRLPRLHTAGRASGGCDRSAPSVPRTPRP

SEQ ID NO: 787926 - protein, 105 aa, Homo sapiens
MPGRIDECRGGARNRPGRTSECRGGARNRPGRTSECRGGARNRPGRTGECRGGARNMPRRTGECRGGARNIAGRGPREGPPVFPSPVQVSRPTAAQAHREEKFLS

SEQ ID NO: 787927 - protein, 154 aa, Homo sapiens
CQRRVRGARRLRTRAAPVPLTSARAGASRAIRRSGRADFQPLSESKFFFRRCLPSDSPSCASSLLHPLQPSVPRPLGVPTSSLPPPPGFLRRRGGGIGEKLGKPGGGDGGGDEGSASCLLESPGVMCSSRPGLGLGALCWPDPRAPAAARGQVQ

SEQ ID NO: 787928 - protein, 215 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSIKPCLDSWE

SEQ ID NO: 787929 - protein, 73 aa, Homo sapiens
LMRGRQELQGQSRDQRNMIAGSEGERRGRHERSNVDLLKELGKAGKQMSLGASRENQLGQHLGFILMRPGSDF

SEQ ID NO: 787930 - protein, 860 aa, Homo sapiens
VSQVHVSAMLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQVRNYYFPSQGPAHHPYRLI

SEQ ID NO: 787931 - protein, 136 aa, Homo sapiens
VSQVHVSAMLPTEVPQSHPGPSALLLLQLLLPPTSAFFPNIWSLLAAPGSITHQDLTEEAALNVTLQLFLEQPPPGRPPLRLEDFLTCTRYGYIRHNHIINWMFGSWDTSLVVHTKYDYLRTNNSAAKLQKREKFK

SEQ ID NO: 787932 - protein, 387 aa, Homo sapiens
VSQVHVSAMLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPETEFHRVNQDGLHLLTS

SEQ ID NO: 787933 - protein, 886 aa, Homo sapiens
VSQVHVSAMLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLEVRRQGKVRLGLERVRAAPSLKNPSLQLSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQVRNYYFPSQGPAHHPYRLI

SEQ ID NO: 787934 - protein, 74 aa, Homo sapiens
YEDPSSKPIVKQNSPSLDCHPLIGGFDDRVSIIKPLGKKTVEEGEEKEQERISTPEGFDEVIDNPFVVNHLLLL

SEQ ID NO: 787935 - protein, 129 aa, Homo sapiens
GGLVGWTGVGVGVGAGAGAGTEVRAGAAGRAIRVQRSNRLLSLSLSTSPAKGSVEGPPEAPAPRSFRSRSCRRFSRSLARSCRLHNLYKLWQDSLKKKKERKRKKHCHYHWAFAPALCLKFSDPGSLHV

SEQ ID NO: 787936 - protein, 128 aa, Homo sapiens
VVLYIIEYYTAIKMRLHVPIVLIENGLQDVSLITKDKVQNIVCNICCHLRDQKRVHICICLGMLSHIPRSIHKKLSTMVVLREGSWEVGRRAYPSCIPFRNLHGLSYVNHLPIQETYKNFKGRRQRKD

SEQ ID NO: 787937 - protein, 57 aa, Homo sapiens
KDGNALISAMRNYSSAVQKFSQTLQSFQFDFIGDTLTDDEINIAESFKEFAELLNEV

SEQ ID NO: 787938 - protein, 60 aa, Homo sapiens
MQITRSASQVAGTTDYSSAVQKFSQTLQSFQFDFIGDTLTDDEINIAESFKEFAELLNEV

SEQ ID NO: 787939 - protein, 30 aa, Homo sapiens
MKCLLLAGALSKGDKAAVILFPPSMGRCNL

SEQ ID NO: 787940 - protein, 102 aa, Homo sapiens
MDTRQHRARSHSNTRTLVQGVCTLTVPSASHTHTHAMRTDILIHTHTSHSHTYYMPPHTCLTLTICTHRHAHPHTPIPTLGAHTLTGTHKAAQSTLARTRVW

SEQ ID NO: 787941 - protein, 78 aa, Homo sapiens
PTSKRKRVKFTTFTAVSSDDEYPTRNSIVMSSEDDIKWVCQDLDPGDCKELHNYMERLHENVYSQTHTDIGSHSPFSL

SEQ ID NO: 787942 - protein, 237 aa, Homo sapiens
DELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADDDSVDPFWPALHCFMVILDRLGSKVWGQLMDPIVAFQTIINN

SEQ ID NO: 787943 - protein, 213 aa, Homo sapiens
DELYIVDNNGEMPLFDITGQDFENKLRVPLLEILKYPYLLLHERVNELCVEALCRMEQANCSFQVFDKHPGIYLFLVHPNEMVRRWAILTARNLGKVDRDDYYDLQEVLLCLFKVIELGLLESPDIYTSSVLEKGKLILLPSHMYDTTNYKSYWLGICMLLTILEEQAMDSLLLGSDKQNDFMQSILHTMEREADGNKLYLLNVVEYSDDDAL

SEQ ID NO: 787944 - protein, 76 aa, Homo sapiens
LIVSSPKIFYFQAWKLVLHILFYNFLYQYISQSLEVHCKLLFFSFSLFSFLPSFLPSLSLSFFLSLGLQARATMPG

SEQ ID NO: 787945 - protein, 70 aa, Homo sapiens
YRSHILLPSAPLLSVQTDEFGANVYAYVTIASINTSKNIPSPKELPHALLQSTLTLMPLISITTIWFYLF

SEQ ID NO: 787946 - protein, 145 aa, Homo sapiens
GQQKTSQHSTSSSGGTKASVSRTACMNTRSTIRWLLAMTSGNGERPSRPRAVSTWRPSSGSAWVPTSTRGTAPGSHGRRRRLLGGLTARNEASLHTPGSTAEPSPWRMSRSWSVTRCSAPAASTTSSNAGAAFASISSRSRSSAH

SEQ ID NO: 787947 - protein, 124 aa, Homo sapiens [sequence omitted]

SEQ ID NO: 787948 - protein, 519 aa, Homo sapiens
MAEDEPSGALLKPLVFRVDETTPAVVQSVLLERGWNKFDKQEQNAEDWNLYWRTSSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILINDNLKPWLLEVNYSPALTLDCSTDVLVKRKLVHDIIDLIYLNGLRNEGGEASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 787949 - protein, 617 aa, Homo sapiens
ASAHFSWRCSCCTETHRGHPRNQRPMRGRDLCSSTQSQALGSLRTTTPAFTLNIPSEANHTEQPPAGLGARLQEAGVSIPPRRGRPTPTLEKKKKPHLMAEDEPSGALLKPLVFRVDETTPAVVQSVLLERGWNKFDKQEQNAEDWNLYWRTSSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILINDNLKPWLLEVNYSPALTLDCSTDVLVKRKLVHDIIDLIYLNGLRNEGGEASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 787950 - protein, 105 aa, Homo sapiens
VFVPSGRIKEIVKKHSQFIGYPITLFVEKERDKEVSDDEAEEKEDKEEEKDKEEKESEDKPEIEDVGSDGSKMAYLPSDSGPAWDLTFKANSASLLSLSIPDHQV

SEQ ID NO: 787951 - protein, 74 aa, Homo sapiens
LPLPTTGNGILYSTPRQHSVDDLTLRMRESQVSAVVSILEVDLGVLQVCVNVQRFTDRRMTFIKTWDLWDHHCL

SEQ ID NO: 787952 - protein, 51 aa, Homo sapiens
KALSTVTNTLSATLSVTSEPHSESWVCIPKSACTIRMVKDLLYFTSVKGYD

SEQ ID NO: 787953 - protein, 114 aa, Homo sapiens
MLLPPGSLSRPRTFSSQPLQTKLMTHNGLFRPIPYVTAASADEATASQQPPQAQLHRYNGLFRPSSCLPAFSPGPELSQDDLSQAQLLHHGGPSRPSLSAPVRSNRETQESPEE

SEQ ID NO: 787954 - protein, 125 aa, Homo sapiens
MLLPPGSLSRPRTFSSQPLQTKLMTHNGLFRPIPYVTAASADEATASQQPPQAQLHRYNGLFRPSSCLPAFSPGPELSQVDLTRPSSCFLDDLSQAQVLHHGGPSRPSLSAPVRSNRETQESPEE

SEQ ID NO: 787955 - protein, 125 aa, Homo sapiens
MLLPPGSLSRPRTFSSQPLQTKLMTHNGLFRPIPYVTAASADEATASQQPPQAQLHRYNGLFRPSSCLPAFSPGPELSQVDLTRPSSCFLADLSQAPGPASWWTLQAQPLPPVRSNRETQESPEE

SEQ ID NO: 787956 - protein, 114 aa, Homo sapiens; identical to SEQ ID NO: 787953

SEQ ID NO: 787957 - protein, 114 aa, Homo sapiens
MLLPPGSLSRPRTFSSQPLQTKLMTHNGLFRPIPYVTAASADEATASQQPPQAQLHRYNGLFRPSSCLPAFSPGPELSQADLSQAPGPASWWTLQAQPLPPVRSNRETQESPEE

SEQ ID NO: 787958 - protein, 111 aa, Homo sapiens
MTLCGCCWVQSWSSWKMLSLHSMIQCSWMATSCTFHILVAMPKPTSKTRPPLEVVKAAKGVAVGALLLQMEPQLGTRRARAQSLQPSHFSHTSFLLAKPTQPLNKEAESMG

SEQ ID NO: 787959 - protein, 111 aa, Homo sapiens; identical to SEQ ID NO: 787958

SEQ ID NO: 787960 - protein, 104 aa, Homo sapiens
QTGRCSQLISHPMSRNPPWGPWISRSQWLPHLLKLKRRETKKQEAPRPIRGCLPDVPLPLHDLCGWVHCLGSENHSRHQTQGPHPPMGGTNFISKMIQFPSNVQ

SEQ ID NO: 787961 - protein, 309 aa, Homo sapiens
GYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASASTVIDGPTQILVRDVSDTVAFVEWIPPRAKVDFILLKYGLVGGEGGRTTFRLQPPLSQYSVQALRPGSRYEVSVSAKPRDQRERFRHRTPFPTG

SEQ ID NO: 787962 - protein, 212 aa, Homo sapiens
MEVLRRSSVFAAEIMDAFDRSPTDKELVAQAKALGREYVHARLLRAGLSWSAPERAAPVPGRLAEVCAVLLRLGDELEMIRPSVYRNVARQLHISLQSEPVVTDAFLAVAGHIFSAGITWGKVVSLYAVAAGLAVDCVRQAQPAMVHALVDCLGEFVRKTLATWLRRRGGWTDVLKCVVSTDPGLRSHWLVAALCSFGRFLKAAFFVLLPER

SEQ ID NO: 787963 - protein, 212 aa, Homo sapiens; identical to SEQ ID NO: 787962

SEQ ID NO: 787964 - protein, 109 aa, Homo sapiens
MEVLRRSSVFAAEIMDAFDRSPTDKELVAQAKALGREYVHARLLRAGLSWSAPERAAPVPGRLAEVCAVLLRLGECALVGSPAAPPPLLGRSLPPRPRWGSGPGAPTPC

SEQ ID NO: 787965 - protein, 217 aa, Homo sapiens
FAITSINANPIIHLQYKGHASGPRTRLQTLERTSTNEEDNPIFKWTPGNTQAAGAGSRSPLLCLAGAAPAWSPSPGASRELARSSLSGEARKASPRLRPQGCLSLRRPSPKPSLSPAGSRALPTSLPRPPTPRQEPPKSAGSPVDLALPARAWTGRAPGRGARPRGSEWKGRGRRRRRADPEARTPPRRPRHAAGEASRGARWCPCMRWPRGWPWTV

SEQ ID NO: 787966 - protein, 212 aa, Homo sapiens; identical to SEQ ID NO: 787962

SEQ ID NO: 787967 - protein, 91 aa, Homo sapiens
SAYCHRDGALTADPHAPQQGTAASMVLHAHNRMLCSQEKAMRRIYILLWREKNRVQNNEDNMQAFFFGLRQSLPLSPRLDCSGLIMAHCSF

SEQ ID NO: 787968 - protein, 72 aa, Homo sapiens
NMIRIELVPRLQLGISYYLIILITLPMFSHFPHSLQSLQPDLTAIILMSHLNYLSSLTFDLIISNVLAIFSI

SEQ ID NO: 787969 - protein, 84 aa, Homo sapiens
GEGVAPLLAGSRGHTRATLFQPQKARLSSLDPPRASGTLGPTHPCLGGREEAAPLCEVFLTLLPHLVSRKGGNMTCWELSGPEL

SEQ ID NO: 787970 - protein, 126 aa, Homo sapiens
AARLKHKRHPRKIQEPSPLKQEANTFLDDIAKQERTARKRPGVYELVSVIEPSRRKNHSDRVLSLSLPNTERRTIINGWRQLRRSNAKKQLHAQEKTLPLLLRDRSVHTSIAEKHSKVYPSPKHVL

SEQ ID NO: 787971 - protein, 69 aa, Homo sapiens
KSPDSSLNKMKLYNLSDRQIKITIIKMLRKLKRIMHEQNENSNKQIENIRKYQTEIMRLKNTITKVKNN

SEQ ID NO: 787972 - protein, 251 aa, Homo sapiens
VASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 787973 - protein, 183 aa, Homo sapiens
MTTASTSQVRQNYHQDSEAAINRQINLELYASYVYLSMSYYFDHDDVALKNFAKYFLHQSHEEREHAEELMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 787974 - protein, 103 aa, Homo sapiens
MREPGGAVLATRYRKFWYPKTTPLYSPRLGRAASQDRLIPEPPPLPPRHRCPSSWTCIGMGLQSRKGGLGAGPPHSVGASLEGFLLATQLHDLASGRPDPGPA

SEQ ID NO: 787975 - protein, 164 aa, Homo sapiens
GTRSCFCFFETEFHSVAQAGVQCCDLGSLQPPPPGFKRFFCLSLPSDWDYRHAPPGPGNFFAFLVETGLHHVGQAGLELLTSSDPPASASHSAGITGVSHHAQPRPLRMFVEWVGECAEAWSPVQSHSFLMKLTYKLERERQKVKTTGDKCQIVINAIQKNKAK

SEQ ID NO: 787976 - protein, 108 aa, Homo sapiens
SLTQGPPAPPPPTQQSPASSLTQGPPAPPPPTQQSPVSRAAPFVDVLQASLTSLCFRHCFSQTGGLWQPCTKHVCGHHVSNSRCPLHISVSRFNNAHDVPSFLIAIIS

SEQ ID NO: 787977 - protein, 46 aa, Homo sapiens
VRISALEKKPQLRPNNKKKEQAGQGEWVVLGEPASFRRGRNSSRIN

SEQ ID NO: 787978 - protein, 112 aa, Homo sapiens
MYPPTETHNLTDTYSLTYSPFVSSRRFLWTAFESQNARLSLSARLARPHIGHEGEAVMVLGNIHVCFYALATQITSAAGPFINITYLPKSFCLCTSKKFQQKGDKPNTIIHL

SEQ ID NO: 787979 - protein, 118 aa, Homo sapiens
VDGWRSGRGSPGESKVPEDRGTPVAQLLNLGAPELSRAHRLPRELGQLLAPPDLCDPTSSGCPDLCDPTSRGSPDLCDPTSSGSPDLCAPTSSGSPDLCAPTSSGSPDLCAPTSSGSP

SEQ ID NO: 787980 - protein, 85 aa, Homo sapiens
CRYQHIWALSPWSAVLILTISAPREQAKNKNTYHPCPALENLIVGENDGFQLHPCPYKGHELIVFYGCVVFHGVYVPHFLNPVYH

SEQ ID NO: 787981 - protein, 642 aa, Homo sapiens
QAQAEAFARQIYGPECTFKASHGWFWRWQKRHGISSQRFYGEAGPPAPSPAPGPPVKEEPALPSGAGPLPDRAPAPPPPAEGGYGDEQIYSASVTGLYWKLLPEQAAPPGAGDPGAGGCGRRWRGDRVTVLLAANLTGSHKLKPLVIGRLPDPPSLRHHNQDKFPASYRYSPDAWLSRPLLRGWFFEEFVPGVKRYLRRSCLQQKAVLLVAHPPCPSPAASMPALDSEDAPVRCRPEPLGPPEELQTPDGAVRVLFLSKGSSRAHIPAPLEQGVVAAFKQLYKRELLRLAVSCASGSPLDFMRSFMLKDMLYLAGLSWDLVQAGSIERCWLLGLRAAFEPRPGEDSAGQPAQAEEAAEHSRVLSDLTHLAALAYKCLAPEEVAEWLHLDDDGGPPEGCREEVGPALPPAAPPAPASLPSAIGGGEDEEEATDYGGTSVPTAGEAVRGLETALRWLENQDPREVGPLRLVQLRSLISMARRLGGIGHTPAGPMTVCDQASPVTFLLLHLEGGDIHTVSHLSSPPPGVAHRMGTGGSRNPNPAWLGGALLVRGRPASLAPWGHSWKRGLAHAPLRAGTCTGHTRHSACWNRWLCSCSGPRAAGPPPLHQSHALDEGRNSCLLSSPGAMWPRSHSTIISVAKHTT

SEQ ID NO: 787982 - protein, 495 aa, Homo sapiens
QAQAEAFARQIYGPECTFKASHGWFWRWQKRHGISSQRFYGEAGPPAPSPAPGPPVKEEPALPSGAGPLPDRAPAPPPPAEGGYGDEQIYSASVTGLYWKLLPEQAAPPGAGDPGAGGCGRRWRGDRVTVLLAANLTGSHKLKPLVIGRLPDPPSLRHHNQDKFPASYRYSPDAWLSRPLLRGWFFEEFVPGVKRYLRRSCLQQKAVLLVAHPPCPSPAASMPALDSEDAPVRCRPEPLGPPEELQTPDGAVRVLFLSKGSSRAHIPAPLEQGVVAAFKQLYKRELLRLAVSCASGSPLDFMRSFMLKDMLYLAGLSWDLVQAGSIERCWLLGLRAAFEPRPGEDSAGQPAQAEEAAEHSRVLSDLTHLAALAYKCLAPEEVAEWLHLDDDGGPPEGCREEVGPALPPAAPPAPASLPSAIGGGEDEEEATDYGGTSVPTAGEAVRGLETALRWLENQDPREVGPLRLVQLRSLISMARRLGGIGHTPAGPYDGV

SEQ ID NO: 787983 - protein, 41 aa, Homo sapiens
IPVSISVLGPACSHFPLILAPLPAHLSSSVPSSPLSPSPSA

SEQ ID NO: 787984 - protein, 123 aa, Homo sapiens
MRIVSFLLSKCHHPSSACSVWGISWSFWQHLRGDTITLIFVGTSPTGSVGFSPCVWRRDCRNKDTRQRHKRKDSWARGTTTTKMRGPVVAPNVWLHCYLLDTKQKGQGKECESSPMIGKVTWV

SEQ ID NO: 787985 - protein, 113 aa, Homo sapiens
MELSGPATASPLPVRDAVNPGVASPAGPGQVSTLEGPQTKGTSVLQTLKGNSEPSGLPRLPTATWPQLLPTDMRCGPFREKLLEEVAPSQSRGAQLGGRMGSPGGWTICQPRQ

SEQ ID NO: 787986 - protein, 112 aa, Homo sapiens
MSRLHANFSSCPLSAGTTSTDCCRLYFLSGLQDDFIFDQGTYPTLRYESFHAQSGIKLIPMRASHIQGCTKHYRPHRNRDPIWEFSVPHGMKALDMKLLVFVFHFYVLKGQF

SEQ ID NO: 787987 - protein, 141 aa, Homo sapiens [sequence omitted]

SEQ ID NO: 787988 - protein, 125 aa, Homo sapiens
MAVVARLAGHPLLEASQKSPCAIHAEPRWSFSRPKVCATLLLPHPEELQARPTSFRGGELLGLTARPITSPIDHNHLQLVVTVGEEAGHHATEAVTREAGLLSLLRHPQVLQQAALPPVVGLRDR

SEQ ID NO: 787989 - protein, 104 aa, Homo sapiens
MPGPAAPQVSPPQSPLSLNLHWGGPRGLSCGTGSSCLRSSRAWKMRSSGMQASYSKPCCDCVGQRNQETESSRKPEAEKRRIRKAHNRWQNRGLVRDMPRDGRS

SEQ ID NO: 787990 - protein, 45 aa, Homo sapiens
AGITGVSHRAQLLITLITRIIISSTSITVVEASIATSTTSAAAAM

SEQ ID NO: 787991 - protein, 98 aa, Homo sapiens
KANNGTVLLPAQPEPPLSERPQLPPAEDFKMIFAWVGLWVQGSVTNHCAQVGALACLLRSKLFPATGSSYGDLKDPRGVVGTARGPCRDLHRGRFLDV

SEQ ID NO: 787992 - protein, 118 aa, Homo sapiens
NFSNTHQCFFYRKIKDTHSVSLNFYPFKTQIQASPTFRRYALFYSAPKAPAAQQQLHKRINQGITVGFLKCIYFNLLWIALYSFTQLLLFANCIILYWSPHINLGIYVGRKQDSHGIT

SEQ ID NO: 787993 - protein, 270 aa, Homo sapiens
VLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLL

SEQ ID NO: 787994 - protein, 107 aa, Homo sapiens
FTNLSPVVTSPSDHRQEMSSAGKNSSHYIGSIQIIQDNCSHVKVFNSISPAMSLLSCKLTYSWSRDISGRSLFWLPCKPNSLQSDHMTLSFIMGNINYRTEHWMHCH

SEQ ID NO: 787995 - protein, 79 aa, Homo sapiens
PKNKPGENIGRYGRVLIRTRGERSQASPSPRKELHSLFYRLRLLQPLNALPGGGEVPLSENCFFYLIIITHPCLVASMV

SEQ ID NO: 787996 - protein, 72 aa, Homo sapiens
QEIWDYGKRPNLRLIGVPENDRENGTKLENTLQDIIQENFPNLAKQANIQIQEIQRMPQRYSSRRATPYLCF

SEQ ID NO: 787997 - protein, 144 aa, Homo sapiens
WHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQPERE

SEQ ID NO: 787998 - protein, 68 aa, Homo sapiens
LGFEARSTELCNSFPTKYTHKHTHTQAHTHTNTHTHLNSMPKPPPPPSIVSHFTPSIWDPLSSPTTAW

SEQ ID NO: 787999 - protein, 171 aa, Homo sapiens
LEEKHVGFSLDVGEIEKKGKGKKRRGRRSKKKRRRGRKEGEEDQNPPCPRLSRELLAEKEPEVLQDSLDRWYSTPSVYLGLTDPCQPCRSAFYVLEQQRVGLAVDMDEIEKYQEVEEDQDPSCPRLSRELLAEKEPEVLQDSLDRWYSTPSGYLELPDLGQPYRSAVYSLE

SEQ ID NO: 788000 - protein, 88 aa, Homo sapiens
SLTGARAARRSNPNVSGKPVFHCGNVIEDPITVTIGNLQCKRNALLGGSFCSQLCRSEVWVPRHLIFLLCFLRAKWKREGTNTHFARG

SEQ ID NO: 788001 - protein, 105 aa, Homo sapiens
AGLGRVVVAVEDQLLSPCVFGGRGTSERRVSCHSALVWKLRCCEVSREVGGVWQIVSESWEMVYDALSIILHLSVVNFIVILATSYFGFVNKKIFPGRAQWLMFV

SEQ ID NO: 788002 - protein, 110 aa, Homo sapiens
STNSAQFFHIVHSFSTSSSMLVIFYFIDSSHPNRYEVILVRFHAADKDIPKTGQFTKERRLLDSQFHMAGEVSQSWWKVKITSHMAADKSLCKKTPIFETVRYCDTYSLS

SEQ ID NO: 788003 - protein, 151 aa, Homo sapiens [sequence omitted]

SEQ ID NO: 788004 - protein, 100 aa, Homo sapiens
LFCIRRVGDSDYSDGEEDFYYTEIKLNTDSVADGLSSLAPVSPSQSLASPPTFPIPDSSRTETPCAKTETKLMTPLSRSAPTTLYLVHTDHAYQVTCRGL

SEQ ID NO: 788005 - protein, 111 aa, Homo sapiens
ARQDAGWVPAGALAGRGLRADAAARRAAPFGRLLRVGAFGGRRALVGGGGGAGAGSSGVPEAPGVAGAGARRGRRVAWRCLFAARASLRPLRGTAREAGGPVRLAPGRGPP

SEQ ID NO: 788006 - protein, 368 aa, Homo sapiens
RGKMLDGSPLARWLAAAFGLTLLLAALRPSAAYFGLTGSEPLTILPLTLEPEAAAQAHYKACDRLKLERKQRRMCRRDPGVAETLVEAVSMSALECQFQFRFERWNCTLEGRYRASLLKRGFKETAFLYAISSAGLTHALAKACSAGRMERCTCDEAPDLENREAWQWGGCGDNLKYSSKFVKEFLGRRSSKDLRARVDFHNNLVGVKVIKAGVETTCKCHGVSGSCTVRTCWRQLAPFHEVGKHLKHKYETALKVGSTTNEAAGEAGAISPPRGRASGAGGSDPLPRTPELVHLDDSPSFCLAGRFSPGTAGRRCHREKNCESICCGRGHNTQSRVVTRPCQCQVRWCCYVECRQCTQREEVYTCKG

SEQ ID NO: 788007 - protein, 92 aa, Homo sapiens
LCKLGELREEYESLRKLREEKLQEEKPSEDQIHKLLPEDTETGKRKMDEQKKRDEPLVLKTNLERCPARLSDSENEEPSRGQMTQTHRSAFV

SEQ ID NO: 788008 - protein, 116 aa, Homo sapiens
MEPRPLTSKDVILLEGHGFVYMCEIFKHTEKQIDWHNELQVSIIQFQQPLAFCLSCFIWPTSPYTHSIPVDPLWVCSRFPDRVASLAFSPLSSLVGTLISHLLYQQSPRGEINLFQ

SEQ ID NO: 788009 - protein, 105 aa, Homo sapiens [sequence omitted]

SEQ ID NO: 788010 - protein, 59 aa, Homo sapiens
MSAPKLLVLSLPPFPLWSTPYHAPQCGILESHFASPVPSRLHQASVEGRAPAFALSLGV

SEQ ID NO: 788011 - protein, 33 aa, Homo sapiens
MQLQASKGPGLPAATRNRGEARTGSSLDPVNSS

SEQ ID NO: 788012 - protein, 144 aa, Homo sapiens
PRRRRRESSSQEEEVIDGFAIASFSTLEALEKDMALKPHERKEKWERRLIKKPRESETCPPAEPSENRRPLEAGSPGQDLEPACDGARKVPLQPSKQMKVTVSKGGDRDSDDDSVLEATSSRDPLSDSSAHAVSGRGYSVSLPA

SEQ ID NO: 788013 - protein, 128 aa, Homo sapiens
GDSCADLALKQYEIVTLLWTSHYAFGSQAPLPWTPLHPKLQVIQLHPSEQSSAVTSSKDLPSRLSSRRAPTLLFAPLSLEVLLSFVEVKRGGVALNFSKLQGHVLFYPRSECVGHHSMPLTDHQLQNI

SEQ ID NO: 788014 - protein, 177 aa, Homo sapiens
PPPPLPLPPGIGTYPLHPLLFALSPGRSHPPTAPSPDNTIRLSERPNPRLAPRMLPKPEGSRSTFLAGRLWQGEGGGRRGVLERREGVAAALTLQPCLQLVGCRRGQPAPACTRSGKSCRENTVWPGEAQTLLLLSLLKGTETFPALLRRSPSADSTAAPTALPASRPSLLGSWTSL

SEQ ID NO: 788015 - protein, 144 aa, Homo sapiens
VYVPFLIVGSIFIAFIILGSVVAIYCCTCLRPKEPSQQPIRFSLRSYQTETLPMILTSTSPRAPSRQSSTATSSSSTGGSIRRFSFARAEPGCLVPSPPPPYTTSHSIHLAQPSGFLVSPQYFAYPLQQEPPLPGKSCPDFSSS

SEQ ID NO: 788016 - protein, 106 aa, Homo sapiens
DPATKSLTPSTAEGPQAPAPTVLPPATLIGGGTLQVGECPYRLSHSCRHPGHTPLRLQLHGLGKVLLESACISSRSSNACSSLPGLLPPFLTPDPIKELTYREALY

SEQ ID NO: 788017 - protein, 146 aa, Homo sapiens
GNPDSDRSGEPQERPAPRSSRPAAPTSPAAPGGLTKAVAARVAFSIQAFASSSPPSLPKAKMAGPGENLGSGGPSPAILTPPARRGCGLPADDVAAAAPERIFGPGPRRHPSSLLLPSRPEELMPLSPPPPLLKPRLMDARECRIA

SEQ ID NO: 788018 - protein, 116 aa, Homo sapiens
TKIHGCSSSSAVCPEDRKTSYTHIQKVSRLYLWVPHPTNAIIFHPSWLNLQVQNPWIQKPDCISFFSETESCSVAQVGVQWCDLSSPPPPPPRFKRFSCLSLPSSWDYRCTPPMPG

SEQ ID NO: 788019 - protein, 80 aa, Homo sapiens
GLHKVTDDTNVTRLQLETEMEALKEELLFMKKNQEKEVKGLQALIASSELTMEVNAPKSQDLSNIMADLPAQYDELAQKN

SEQ ID NO: 788020 - protein, 103 aa, Homo sapiens
STPSPRAPCCLWSLTARTYNNSLFAEESDTFPRPALTPRSPQKKASSPRNLLATSPNYAWFYSLFSPLIFFSIIHPWWPGTLQESKFKNRIKLRFCSSTENKT

SEQ ID NO: 788021 - protein, 92 aa, Homo sapiens
LRKVSMDNRLMELFPANKQSVEHFTKYFTEAGLKELSEYVRNQQTIGARKELQKELQEQMSRGDPFKDIILYVKEEMKKNNIPEPVVIGIVW

SEQ ID NO: 788022 - protein, 91 aa, Homo sapiens
MPLLVSSVTTELPSSTKSTTLAHPVGATGLSLKELSEYVRNQQTIGARKELQKELQEQMSRGDPFKDIILYVKEEMKKNNIPEPVVIGIVW

SEQ ID NO: 788023 - protein, 102 aa, Homo sapiens
MNWTQAPNYRADTRLCLHQAIPGFLQLQDSLPASRCSYSHSSFVSCLMQNLYSFLFQSLLHILCDKARSWKSSSELYTQLCHKCAMTLNKSHDLSGPGFSHL

SEQ ID NO: 788024 - protein, 414 aa, Homo sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 788025 - protein, 425 aa, Homo sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVVRHYFLYQTIYSIKMLL

SEQ ID NO: 788026 - protein, 414 aa, Homo sapiens; identical to SEQ ID NO: 788024

SEQ ID NO: 788027 - protein, 392 aa, Homo sapiens
MNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVVRHYFLYQTIYSIKMLL

SEQ ID NO: 788028 - protein, 98 aa, Homo sapiens
GSIPAQLPLSQDRCCTAVSSSCREGAACPAQPQGEGVCVQKGLGNQGGHEAVGISVTEASCITVDFSGGRIGLFYKSAFLVNELSLLLTAYCPCSEYS

SEQ ID NO: 788029 - protein, 48 aa, Homo sapiens
MGLERDGDGAVLFQLEQPGRLWQLSGDLNKVSEEPGAVAHTCNPSTLG

SEQ ID NO: 788030 - protein, 130 aa, Homo sapiens
MSSQDGSTSSTEGLQTMLFDYNIDEEKRNQFLAGVTLCVEFEHCPHVCLDYKDPCNPSSRHHHHHHHYFGLFVFETDLALWPMLECSGIITAHRILRLLGLGDPATSASQVAGTTDTSYHAWLIFWFLFL

SEQ ID NO: 788031 - protein, 128 aa, Homo sapiens
QLLRSFGTKNGLKPGKEGSNPPWGQKEKRVPKKKKKKKLGLSSVRNASFPLETGDHLFCSDGTCMSDLQKAGKRSFVERVPLAFDSRFLKEKDYEELLLQEIKIASRNRSGLPLLHWMIMPDGHHHCC

SEQ ID NO: 788032 - protein, 110 aa, Homo sapiens [sequence omitted]

SEQ ID NO: 788033 - protein, 106 aa, Homo sapiens
HGFAHLPASGSDFISGWDRCVSVFIDPLHQKYLYISVSLHPKVKALATSEVPIASVFPKPCHFLPFLWVRNLAFVFHISFSQDIGRHLVNNTNKTVLSPRSSRSLL

SEQ ID NO: 788034 - protein, 180 aa, Homo sapiens
DEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKQATTVELFLFHLTSG

SEQ ID NO: 788035 - protein, 180 aa, Homo sapiens; identical to SEQ ID NO: 788034

SEQ ID NO: 788036 - protein, 257 aa, Homo sapiens
MGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRKGRCGKGYAWISPCKMSLHFCLCWPSVYWTERFLEDTTLTITVPAVSRRVEELSRPKRFYLEYYNNNRTTPVWPIPRSSLEYRASSRLKELAAPKIRDNFWSMPMSEVGAPCP

SEQ ID NO: 788037 - protein, 251 aa, Homo sapiens
EQWSCGWSRPSWCQSPPSETPRGKGEAGGQGECRQKALEQDPRFSGLPNASGRESSSNFNVEFSQSRLSISQKLPSTTMTKARKRRRRRRLMELAEPKINWQVLKDRCPRYPGQPKWQSPARGSSSCQSRRPQPPSWKSGTPCQNPSHMCQTITASFTWPGPKLQSDKCVPDRDPRWEVLDVTKKVVASPRIISLAKPKVRKGLNEGYDRLSLASMSLPPPKASPEKCDQPRLASKNSAPSKHLRHPNLCM

SEQ ID NO: 788038 - protein, 139 aa, Homo sapiens
GEKPYKCNVCGKDFAYSSVLHTHQRVHTGEKPYKCEVCGKCFSYSSYFHLHQRDHIREKPYKCDECGKGFSRNSDLNVHLRVHTRERPYKCKACGKGFSRNSYLLAHQRVHIDETQYTHCERGKDLLTHQRLHEQRETL

SEQ ID NO: 788039 - protein, 173 aa, Homo sapiens
LRTRSHHLSLRTRYTMLRIRYTMLRLRTRYTMLRLRTRYTMLRLRTRYTMLRLRTRYTMLRLRTRYTMLRLRIRYTMLRLRTRYTMLRLRITYTMLRLRTRYTMLRLRTRYTMLRLRTRYTMLRLRTRYTMLRLRIRYTMLRLRTRYTMLRLRIRYTMLRLRIRYISFLSSGQ

SEQ ID NO: 788040 - protein, 372 aa, Homo sapiens
GKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLGTLNWKARQQRRTRPQDRKHGLRSKQPAGESPEKGRERTTRKNKRKQRKRRQPSEHDDEEKRKRKTRKTYTQD

SEQ ID NO: 788041 - protein, 82 aa, Homo sapiens
LAAEGLAHRTEKATEGAIHAVEEVVKEVVGHAKETGEKAIAEAIKKAQESGDKKMKEITETVTNTVTNAITHAAESLDKLGQ

SEQ ID NO: 788042 - protein, 126 aa, Homo sapiens
SPPKTPCLTLAVPTDLYMEEDTGRFALQQAQKASSRFAQLESKGLNTSRCLNGSGRRGRAPSTPMASPDSSLLPTPSEGQGKTCQDKMAVLGDGEMTANVPREHGIRSTPERADPQPEKEAMFIHL

SEQ ID NO: 788043 - protein, 64 aa, Homo sapiens
MSQPPIGGAAPATAAASPAAAATEARLHPEGSSRKQQRAQSPARPRDSSLRQTIAATRSPVGAG

SEQ ID NO: 788044 - protein, 181 aa, Homo sapiens
ALELQQREEVVTEQRDKPNVWVLLSSRLSLARGGDLKGARKVAKGTARAKAQRRVEKRAGAGAGVAAVGGPGLRARHSKPLLSDGPGQGSARPHPGPSVGDLSPQHPSCRGPGRSTVSRGDSGWEEPVGSDRKGLGQGSEGFSVSQTVHSGVSHWGQDSLPASVPCHLCVHPISPTSLSNL

SEQ ID NO: 788045 - protein, 110 aa, Homo sapiens
TVLQSLSEAGIIIAILPKGKLSLRKVKQFAQGHSARLSGKSKAFPPERTPTIRHVDLLGYKSRKSPRCSISQKTRSGRAQWLMPVIPALWDAKAGGSLEVRRSRPVWPTW

SEQ ID NO: 788046 - protein, 79 aa, Homo sapiens
STAPSPIDHPTAEECGRTARDWQAAPPAAPVRDPLGEASWAPESADLIYLPMYLMNGLSRDWQKEKNKMQRNETESTTV

SEQ ID NO: 788047 - protein, 47 aa, Homo sapiens
ALLGASGPRVGGRGAAPGELAGGRRAEASRPGGNSPLCPQPSRLRSL

SEQ ID NO: 788048 - protein, 223 aa, Homo sapiens
GGLGRTEEGKRFFVASLCFLFYFIYFIFRFSVLISPREGDLGIHPMSSRELPWPRSESSWDATGSESAPQVSPPAPPNLSDSYSNYSVSCWKRGKGYGETRWYMGHWGEGKASLLLLVIRECCVRLLSFAGARGSDQHLPGIGVATGAKPGRLWKQRFTDRKEKLFFVFITHRRLPHARVLGGAVRFQCVSLNSSTKFVLGAGEGPGSATRGPLELPVGTARA

SEQ ID NO: 788049 - protein, 40 aa, Homo sapiens
MGISASKSIKGYVLVRFYDYAKVEGGALTESPSAAQTSYQ

SEQ ID NO: 788050 - protein, 132 aa, Homo sapiens
SNEKSDTNSPSFHSSPNVSLGYSWLCFQGKGGPRLGDIRRGQRVQFPLPWKFQPFLTSPSILWAPAPGNAFGPLVPDTQDPQLPSDSYTLTCGHSQSHGHSHTASDSDTLTHIHTLTQSHTHTAPTRAHSTA

SEQ ID NO: 788051 - protein, 83 aa, Homo sapiens
NCFGTFVKNQLTTNKLYNKQPIQLKTRAEDLSRHFSKEDIQVANKHEKMHNVSNHKRNANQNHNETSSHTHWEATIKTTTTTK

SEQ ID NO: 788052 - protein, 116 aa, Homo sapiens
MPAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 788053 - protein, 79 aa, Homo sapiens
MGGGSQTCRRYWKAGGGPVIPVTWEAEDGHGLPIEDFLVRDSQGRGGRRGWGPQDCMRQAGGGEAEPGAAGFSPPDQRH

SEQ ID NO: 788054 - protein, 109 aa, Homo sapiens
FCQGTLPTTDTESRRECGVSNVPSTLTNNPQIIPLDPMWRRQDQPTGRVCLWAHSLSCYFWPGHGVFYWWIILFPVGEETTANRATEEYFFLDMESCSVTQAGVQWCDL

SEQ ID NO: 788055 - protein, 118 aa, Homo sapiens
LQSEVPRWAICKLGKERRRKWLKSKSKCLKTREGHSASLSLRLKEMELMSKGRRNRSKRLSWEEEKKPEDSASKLIPPSSICFVPAALAANWMVPTHIEDGSSSPVHHSHVNLLWQHN

SEQ ID NO: 788056 - protein, 76 aa, Homo sapiens
AYPLISNHTQPNPLCLAGQHPPCPRTRGAPFSSFAATLLYTENPILFVLSSLSLQMLSFEAQLVYGQTTLITPDLI

SEQ ID NO: 788057 - protein, 108 aa, Homo sapiens
SQTKQKSTSFPEKITAASKTTYKTTGTPEESEKTEDSRTTVASDKLLTKTTKNIQETISANELTQSLAEPTEHGGRTANENNTPSPAEPTENRERTANENTTLSPAEP

SEQ ID NO: 788058 - protein, 136 aa, Homo sapiens [sequence omitted]

SEQ ID NO: 788059 - protein, 127 aa, Homo sapiens
MKEHETNKSRGFAFVTFESPADAKDAARDMNGKSLDGKAIKVEQATKPSFESGRRGLPPPPRSRGPPKGLRGGRGRSGGTRRPPSWRRHMDDSGYSMNFNMSSSRGPLPVKRRPPPRSGGPPPKSSA

SEQ ID NO: 788060 - protein, 35 aa, Homo sapiens
FTSAAAGGGAHARAVPSEGGGANSNARTLALGCCA

SEQ ID NO: 788061 - protein, 339 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCYGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKALNYETTVPIGKQEKGAKVAGAEAAIRRCLMESLKIVYRN

SEQ ID NO: 788062 - protein, 118 aa, Homo sapiens [sequence omitted]

SEQ ID NO: 788063 - protein, 109 aa, Homo sapiens [sequence omitted]

SEQ ID NO: 788064 - protein, 72 aa, Homo sapiens
SHLALPCLSFFFCKVGGMNRLGWPSAHCAWHPADGEEEQEMRGGAHSGTSSWGWGEGSSLLNSGATCSSAAS

SEQ ID NO: 788065 - protein, 52 aa, Homo sapiens
MGSEPHGPTRPPSLWVSVSVSTYPVSKTGALTAPTPPGGLTAASCSPCPSTG

SEQ ID NO: 788066 - protein, 89 aa, Homo sapiens
RRCDFTLMPSLKCSGCYVSSLQPQPPGLRRSSCLSLLSSWDHRCMPPHLANFLNILQRRGLTLLSRLVLNSRTQVIHLPQPPKMLGLQV

SEQ ID NO: 788067 - protein, 162 aa, Homo sapiens
MCAASFIPPPLTHLTTVWGAPAVGQAGSRVHQQQKQKCPVLLGRHNQQQENSEGGVGHAADMGLGETQAGEGAASSGGSFGARKAWLRGDLGQGHNREVKPLTRSCWRASGMDRVRPTGPSCPPSVPALGRGDDWGARFGWVTARAGQKVLQTKPRITVQGH

SEQ ID NO: 788068 - protein, 47 aa, Homo sapiens
MEILHVIPTAIQAVEHQEVVAVEEADLIEGEAEADTRNKQNFRPKSQ

SEQ ID NO: 788069 - protein, 241 aa, Homo sapiens
YLVMNEHLCGTEPRNFAAAVDPGPHRQGRLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGCVLPLTEPGGKASTSMCLLPPEGSEANEELRQKFERDKISQGTKVPDRKRATKHCLQDFGPTTGNRDRMKLTDFTFLMVLAERQLWHRSMLQNETGTDDSMLSTILQHDVA

SEQ ID NO: 788070 - protein, 106 aa, Homo sapiens
KGQVTVTQPYPLAARSLALRVADEMDLTLGHEVGYSIPQEDCTGPNTLLRWGPLQALPEYNSPYSVESNPFLWHLTIPALPNEFLQPGGSTSSRSGAIAVELQLLF

SEQ ID NO: 788071 - protein, 277 aa, Homo sapiens
LTGSCTLWEAQRRGCCSRWGAREGTLRDCPREWLPTHAPHPTFHSRHDDREVRNGCGDKSVEAARLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCERIGRSCLLLCWCNLYFKWTNDGIVLHVWSIPEWDSTGRSYYSTVILFQPWRGTRVMWTPALREKFSYPSLYFRCVFHLDLKTLAWIEGPHGPGFQGG

SEQ ID NO: 788072 - protein, 208 aa, Homo sapiens
MRKQGVSSKRLQSSGRSQSKGRRGASLAREPEVEEEVEKSVLGGGKLPRGAWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVSHNLRQIIFVE

SEQ ID NO: 788073 - protein, 333 aa, Homo sapiens
MRKQGVSSKRLQSSGRSQSKGRRGASLAREPEVEEEVEKSVLGGGKLPRGAWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCERIGRSCLLLCWCNLYFKWTNDGIVLHVWSIPEWDSTGRSYYSTVILFQPWRGTRVMWTPALREKFSYPSLYFRCVFHLDLKTLAWIEGPHGPGFQGG

SEQ ID NO: 788074 - protein, 77 aa, Homo sapiens
LSFPSSLEVLQRCASPFDQANLLKLPDGYEFKFPNRLNLEAINYMAADGDFKIKCVAFDLKSASPWPPIKAAAFAPF

SEQ ID NO: 788075 - protein, 33 aa, Homo sapiens
AYFKKKKLRKPRHQEGEIFDTEKEKYEITEQRK

SEQ ID NO: 788076 - protein, 268 aa, Homo sapiens
CPGRAPVPPPPAPRLADVGCWPEGSYVAEVCAAAARPGPVPASARTLAGLAMADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTH

SEQ ID NO: 788077 - protein, 62 aa, Homo sapiens
WKTALTSLKDLAMVKRERRDSRAVKDKELLPGGALAPAGVSKELGIRQEDEGARGRGTGSHR

SEQ ID NO: 788078 - protein, 85 aa, Homo sapiens
HRAVLEMKVNHKGYNYTFSHLCVLRNQDKKCVLDDIISVLEDLRQAAVSNKTTARVQVRYPNTKLKVCSFCMLLPIKEAALHFLP

SEQ ID NO: 788079 - protein, 115 aa, Homo sapiens
DPGVSKTAYFIICYACGREWRPRQLEERPCEKRLYSPRKRPTGRPRRSRSHSGNERFKHQSGSFSRSKSKSRSRSKSQPKKEMKAKSRCRPASHTKTRGISKNRFQSTLQVWLKI

SEQ ID NO: 788080 - protein, 127 aa, Homo sapiens
RKEPSRLRGGAGSVAGGPTRVAAKIRVTLRTDVKNVRDPGSAPLRFPEPRPEQPRPCANPGLPWKRRNPNPVEFEAALPGSMQMPPPFGKSWFPSSLHGILLLKAYLVIETSQKLEEAQVHSGPHLF

SEQ ID NO: 788081 - protein, 148 aa, Homo sapiens
HYVLWMGCGFTGHPHLLPLLFPIPSQVGLVFLHCRQNSSLCCALMSGSPSSWAVPWVCLCHAQPSHPDATLIPKSGWARDPSTFPCAPVHFMGKSNLFKLSPPQVPRGGHSKVPVAPVLCQPPHRLNQWPSPGHYHKASWPRCQHLPF

SEQ ID NO: 788082 - protein, 166 aa, Homo sapiens
TEEYTAEIMFESFNVPGLYIAVQAVLALAASWTSRQVGERTLTGTVIDSGDGVTHVIPVAEGYVNGSCIKHIPIAGRDITYFIQQLLRDREVGIPPEQSLETAKAVKERYSYVCPDLVKEFNKYDTDGSKWIKQYTGINAISKKEFSIDVGYERFWDLKSFFIQSC

SEQ ID NO: 788083 - protein, 46 aa, Homo sapiens
MNTWHELHSLNFVADTPVVLTESWLEWRLLSCALDRPFWLTWFKPG

SEQ ID NO: 788084 - protein, 121 aa, Homo sapiens
LPSTCIFVFYFHNSTGVLENVAWTIVYIFSGNQDQRLCARGPDGVRTPGGRKSGDKGCGQEPHRSCTRRSQGRLPCPTERRPRLPEEDKWQERKPRSFLSQSGGWCVSPPPSGRLSILRGI

SEQ ID NO: 788085 - protein, 104 aa, Homo sapiens
TYTCLFFCAPQVWRSTAVRSLYHRVVSPQVPVNLGNGHYPLEDVYRGDFFGKSLGLLLTWELLSSLSCWRLTWPFISSIQTSLHGGGVSSSPVAKPGSVDWHIH

SEQ ID NO: 788086 - protein, 156 aa, Homo sapiens
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDERGGGWEGEENPAPVALRGGLHGPVKDAKS

SEQ ID NO: 788087 - protein, 108 aa, Homo sapiens
MLRSRRPLTACQPLLRCPCRRSLSPGCLLTVGLHHCQHSSLPEGYYEEAVPLSPGKAPEYITSNYDSDAMSSSYESYDERGGGWEGEENPAPVALRGGLHGPVKDAKS

SEQ ID NO: 788088 - protein, 104 aa, Homo sapiens
MPKRKAEGDAKGDKAKVKDEPQRRSARLSAKPAPPKPEPKPKKAPAKEGREGTQREHTREKLMLARRGITLQKMEMPKQTRHRKLKVLEMPSEVCAFLITVYFW

SEQ ID NO: 788089 - protein, 138 aa, Homo sapiens
GGRGEIEPLVYRLKSHRRRVAVMPRSSTYDPVFRRRRYHAHSMMKAETVDANGRVKHEVTGPNLQEERSALVVCYDLLLLKPRALSLEKAPGNRRERRYPKGTHTGKADAGKEGNNPAENGDAKTDQAQKAEGAGDAK

SEQ ID NO: 788090 - protein, 104 aa, Homo sapiens; identical to SEQ ID NO: 788088

SEQ ID NO: 788091 - protein, 104 aa, Homo sapiens; identical to SEQ ID NO: 788088

SEQ ID NO: 788092 - protein, 104 aa, Homo sapiens; identical to SEQ ID NO: 788088

SEQ ID NO: 788093 - protein, 104 aa, Homo sapiens; identical to SEQ ID NO: 788088

SEQ ID NO: 788094 - protein, 104 aa, Homo sapiens; identical to SEQ ID NO: 788088

SEQ ID NO: 788095 - protein, 185 aa, Homo sapiens
PALLGLAAPAPCPLPHREGPFPPLPAGGQFKPERAGRRRSGLAGGGKRCRQKTAAVRGLVRYGPAPRPRSPRTRRALSPPTSSPGCARLPLPPSTAAIATALGSASGGGLFAPSAAVAPACRGGAGSAALPGCAPVQPSLLGVGEPELLRALRSYTNVGLTHLCPRKVVWTTALIFIFSTLKFGK

SEQ ID NO: 788096 - protein, 105 aa, Homo sapiens
MPKRKKAEGDAKGDKAKVKDEPQRRSARLSAKPAPPKPEPKPKKAPAKEGREGTQREHTREKLMLARRGITLQKMEMPKQTRHRKLKVLEMPSEVCAFLITVYFW

SEQ ID NO: 788097 - protein, 174 aa, Homo sapiens
PLSSGSPPPPRAPSPIARAPSLPSLRAGNSNPKGREGGARGWRAGESAAAKKPPPRPRSPRTRRALSPPTSSPGCARLPLPPSTAAIATALGSASGGGLFAPSAAVAPACRGGAGSAALPGCAPVQPSLLGVGEPELLRALRSYTNVGLTHLCPRKVVWTTALIFIFSTLKFGK

SEQ ID NO: 788098 - protein, 104 aa, Homo sapiens; identical to SEQ ID NO: 788088

SEQ ID NO: 788099 - protein, 105 aa, Homo sapiens; identical to SEQ ID NO: 788096

SEQ ID NO: 788100 - protein, 102 aa, Homo sapiens
MPKRKATMPKHEKAETVDANGRVKHEVTGPNLQEERSALVVCYDLLLLKPRALSLEKAPGNSTWENKVPNTGYDRGTMLNCCVKDGGTKRRVTKECETALKS

SEQ ID NO: 788101 - protein, 104 aa, Homo sapiens; identical to SEQ ID NO: 788088

SEQ ID NO: 788102 - protein, 104 aa, Homo sapiens; identical to SEQ ID NO: 788088

SEQ ID NO: 788103 - protein, 104 aa, Homo sapiens; identical to SEQ ID NO: 788088

SEQ ID NO: 788104 - protein, 104 aa, Homo sapiens; identical to SEQ ID NO: 788088

SEQ ID NO: 788105 - protein, 149 aa, Homo sapiens
FFDRSSPMLREDDRKGENDPRTDQSPRAAASRVQHLRPAAVAAATMPKRKAEGDAKGDKAKVKDEPQRRSARLSAKPAPPKPEPKPKKAPAKEGREGTQREHTREKLMLARRGITLQKMEMPKQTRHRKLKVLEMPSEVCAFLITVYFW

SEQ ID NO: 788106 - protein, 104 aa, Homo sapiens; identical to SEQ ID NO: 788088

SEQ ID NO: 788107 - protein, 104 aa, Homo sapiens; identical to SEQ ID NO: 788088

SEQ ID NO: 788108 - protein, 174 aa, Homo sapiens; identical to SEQ ID NO: 788097

SEQ ID NO: 788109 - protein, 174 aa, Homo sapiens; identical to SEQ ID NO: 788097

SEQ ID NO: 788110 - protein, 122 aa, Homo sapiens
MPKRKAEGDAKGDKAKVKDEPQRRSARLSAKPAPPKPEPKPKKAPAKEGREGTQREHTREKLMLAEGKGIPVELVEPPLFVATCCGTKKACGGGHYEHTPTHLVSLVVPHFSLSNLFKGIRR

SEQ ID NO: 788111 - protein, 105 aa, Homo sapiens; identical to SEQ ID NO: 788096

SEQ ID NO: 788112 - protein, 67 aa, Homo sapiens
ALCMPTAPTNFANYRVVATLAFEFPKQVFYLPSMGTPMESEEAFINKQSKRHLYPRCGMESIKTARV

SEQ ID NO: 788113 - protein, 103 aa, Homo sapiens
ARVLTGWSPEIGILGGSTTRKKPQEQESSGRLLGRQCEIPNSGQDLRRVNEAPLPIFTSPATAPVPAAAALPSFILLLFFFNSRSLILSPSLDCSGGISAHCK

SEQ ID NO: 788114 - protein, 104 aa, Homo sapiens
MSGTSQTRNPAHRRPGISTWNMLRQQVRSIPFCSNNKFSGQYDAFCGRIVRKDFEAVNKICSIKRITSNANAQRLPRNLFEDSAYVPDTGLAVQLEAKTRWKMS

SEQ ID NO: 788115 - protein, 346 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 788116 - protein, 333 aa, Homo sapiens [sequence omitted]

SEQ ID NO: 788117 - protein, 333 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIVHQTTQVGLGQSLCVGIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 788118 - protein, 308 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGHGGDHFKDQIYCCLESFDESAQRLFDCEWCMPKMFHLDTISQFSVGLSGRPGKVAGIGEGKTPRGVFADTVDSNPGISSSGLN

SEQ ID NO: 788119 - protein, 121 aa, Homo sapiens
QWYQRRVPITAGDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 788120 - protein, 213 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECAHWASCLGPLFSQKKREGLGALLSPILGDPRF

SEQ ID NO: 788121 - protein, 346 aa, Homo sapiens; identical to SEQ ID NO: 788115

SEQ ID NO: 788122 - protein, 235 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVGFCHRRHHIDW

SEQ ID NO: 788123 - protein, 149 aa, Homo sapiens
MRSLSILTRGPLCTLRCSEKKEINPSLSIGGDPFNGTDFIDCLEIFLNDSATEGIILIGEIGGNAEENAAEFLKQHNSGPNSKPVVSFIAGLTAPPGRRMGHAGAIIAGGKGGAKEKISALQSAGVVVSMSPAQLGTTIYKEFEKRKML

SEQ ID NO: 788124 - protein, 229 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQEKTRLIGPNCPGVINPGECKIGIMPGHIHKKGRIGIVSRSGTLTYEAVHQTTQVGLGQSLCVVRDFC

SEQ ID NO: 788125 - protein, 163 aa, Homo sapiens
MTATLAAAADIATMVSGSSGLAAARLLSRSFLLPQNGIRHCSYTASRQHLYVDKNTKIICQGFTGKQGTFHSQQALEYGTKLVGGTTPGKGGQTHLGLPVFNTVKEAKEQTGATASVIYVPPPFAAAAINEAIEAEIPLVVCITEGIPQQDMVRVKHKLLRQD

SEQ ID NO: 788126 - protein, 67 aa, Homo sapiens
LDALRSRDPEAKQSGSPGAEVEVRDVSGTGKLPLYTLSVGSSHHTSIIHFNQAAANASFSFRLNLLH

SEQ ID NO: 788127 - protein, 41 aa, Homo sapiens
KDLKGSQDLDLKPCLENHHPRAVSPSCQVRKWPGVAEAPSP

SEQ ID NO: 788128 - protein, 44 aa, Homo sapiens
CWDDRGELPHPALEGILALDFHHSPKESIYHDSHAPSEKNQDIR

SEQ ID NO: 788129 - protein, 35 aa, Homo sapiens
SFPVPAPSTPFIRYEVSCYHPRRPLSTQPVHQGTE

SEQ ID NO: 788130 - protein, 75 aa, Homo sapiens
KRKKSLLKKVDVTSRLTPRFAKSGKNLSIWCTSFASPPPPTPEKQHKAPCLPPRRLRRRKPDPSLTFSKHQRREQ

SEQ ID NO: 788131 - protein, 30 aa, Homo sapiens
MFCPLQHLKEPNTNSLYQNTPISPKHTQFY

SEQ ID NO: 788132 - protein, 96 aa, Homo sapiens
PCAPACFCPFPWALGMCVLKPGPQRWSVRRTRSFIASLGPLSYHTEDGAQAPCRGHGHYEGGEPATLVLPVPPTALPDLLGTSPRASSHALVAFTY

SEQ ID NO: 788133 - protein, 105 aa, Homo sapiens
LSYPNGIPCEGFGCGKAENLIEKKDILISWLILSSHTSFKWILKSPCNYRWSPSQSRNVKCLQDAPYRHTLQEAVKEAQFQLLENFEKQYHSQFFCGLPQSFNSC

SEQ ID NO: 788134 - protein, 102 aa, Homo sapiens
SLLWALVTGECHSLAALPAPPSTGVKVGSNSGIRDTLRQGNPLLPVPGGEEGSVPLRLPSRAGTLSLPVLFSKPPCGKSPSALREGRASPGAGARERGQGSQ

SEQ ID NO: 788135 - protein, 93 aa, Homo sapiens
SVIATIASHSAILSVTASELHVHAVAAEEGPSAQWGLQAAWCGGWLRRLAPGTAAGALSQCSQLEKSAQVACEALICPEQFSTFQVAALRLQV

SEQ ID NO: 788136 - protein, 98 aa, Homo sapiens
QNHVMHPVGGHLGTQDMHPDPSSPTHFKESAALPVVMKTFRWPQPLGSGLYLGIHVALGVGFAEVGQSRWVLECAGATRVSICLGEASCLGLKDLFDF

SEQ ID NO: 788137 - protein, 90 aa, Homo sapiens
MSTGVLYGVTKWGSFRDENKICKTTRKDSETSSNHLEEVYRLSIPNSKNLKCFKIQNFLSVYMMPQVEYSTPDIMRQVAVKTQVHNTVLS

SEQ ID NO: 788138 - protein, 80 aa, Homo sapiens
SHSISMATAMVIEQGFLISKQVHISVRDVYTCGISITTYVRECKHKYAYHLENATVGLGIGYKKQLGCGAQGHSLVISAP

SEQ ID NO: 788139 - protein, 70 aa, Homo sapiens
ETEIVTLIDRRHAPRVMENVTHAISGNSTEGALYTISGVIAEKAQKKFGTAGACAKGVYTVRKKCVVGQL

SEQ ID NO: 788140 - protein, 231 aa, Homo sapiens
RVKMYPVEDFEASFQFMQECAQYFLEVKDKDIKHALAGLFVEILIPVAAAVKNEVNVPCLKNFVEMLYQTTFELSSRKKHSLALYPLITCLLCVSQKQFFLNNWHIFLQNCLSHLKNKDPKMSRVALESLYRLLWVYVIRIKCESNTVTQSLFPCSRLMSIVSALFPKGSRSVVPRDTPLNIFVKIIQFIAQERLDFAMKEIIFDLLSVGKSTKTFTINPERMNIVSESSL

SEQ ID NO: 788141 - protein, 133 aa, Homo sapiens
HTDGSLGCASPAFATALKNLYMSEVEINLEDLLGVLASAHILQFSGLFQRCVDVMIARLKPSTIKKFYEAGCKYKEEQLTTGCEKWLEMNLVPLGGTQIHLHKIPQDLLHKVLKSPSFPENCCFLDRDIGRSL

SEQ ID NO: 788142 - protein, 103 aa, Homo sapiens
SQESYYCIKTKEFISLDENQRSYNGRQAVYLLQIINREFTTGEAAEILQYSDNKSLHKVVSHLCLFLQLCAGRSLAQPSSLLSATSGQLLGVEYLVLGNCLCN

SEQ ID NO: 788143 - protein, 102 aa, Homo sapiens
MGWGQLTCRTDHMVPLSQRDSPGIDPVQEAASTFGMPFLQNTQTSETSHSVGQIPQYPVCSIILLSTSRFRALLSISPATTAQGRWNSPRAKDVGFSVRELG

SEQ ID NO: 788144 - protein, 101 aa, Homo sapiens
MDSFNRGGEARTLREKAAAQAGWRTVVGSAGSLGEHGNHFIALGWCDSLPGMFLTVDLILHKEMVPLFQVGATVSAQVTFGMAVTVPQLHEHTDNARTTII

SEQ ID NO: 788145 - protein, 174 aa, Homo sapiens
VSQLSGFSAGFPGTKMVMASDFYLRYYVGHKGKFGHEFLESEFQLDGKLRYANSSNYKNDVMIRKEAYVHKSLMEELKRIIDDNEITKEDDGLWPPPDRAGRQELEIVIGDEHISFFFFFLRRSLALLPKLECNGAISAHRILCLPGSSDSPASASQVAGITGTSHHTRLILYF

SEQ ID NO: 788146 - protein, 116 aa, Homo sapiens
HQRGLQWFIKMAACPLALSSWRSGVYVPSLGVGWACAGFHPWSEHAVEAQAPQEVPVLVALSTASTELSFSVYPAWVPDVGKFPAGKPSAPANEFFPAEAQTSGSRDKPSSCPVST

SEQ ID NO: 788147 - protein, 218 aa, Homo sapiens
VGGGDTRWEVALSLGSKGRRRWRQLRARRRGVRAPWLCPCCLSLWVFTESLPSSVFTSAACRSSWFSSEAGGEPIRPVPRAYSGDSSWRGRAASLRTPALPWVQGVPPAAPPPLPSSPQADSSPLTPNKSHNADSGPQGPAQRSPASSSYISRPSPSPTPVGASNAPQPCSSPACSVPPQVSPGSLTCFRFCSDCAASVRPSVTILCIVGNPCSLSLH

SEQ ID NO: 788148 - protein, 91 aa, Homo sapiens
GHQGVHLEIIVGLVREPNAHVEDVGGETGHCVQQHLGLQVCHQVEDEEGLALFAALQHALEILFFPLNWDLPVELMALPLTLGQRLGSFFM

SEQ ID NO: 788149 - protein, 272 aa, Homo sapiens
MDGPVAEHAKQEPFHVVTPLLESWALSQVAGMPVFLKCENVQPSGSFKIRGIGHFCQEMAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITDGKLVTLPDITSVAKSLGARRWPLGPWSACRCARFTLKLVEDTEGCERCDRVLDEKRIDG

SEQ ID NO: 788150 - protein, 272 aa, Homo sapiens; identical to SEQ ID NO: 788149

SEQ ID NO: 788151 - protein, 107 aa, Homo sapiens
MPRRLQPRGAGTKGPPAPAPAASGAARNSHSAASRDPPASAKPLLRWDEVPDDFVECFILSGYRRLPCTAQECLASVLKPTNETLNFWTHFIPLLLFLSKFCRLFFL

SEQ ID NO: 788152 - protein, 138 aa, Homo sapiens [sequence omitted]

SEQ ID NO: 788153 - protein, 186 aa, Homo sapiens
MTTIPRKGSSHLPGSLHTCKLKLQEDRRQQEKSVIAQPIFVFEKGEQTFKRPAEDTLYEAAEPECNGFPRKRVRSSSFTFHITDSQSQGVRKNNVFMTSALVQSSVDIKSAEQGPVKHSKHVIRPAILQLPQARSCAKVRKTFGHKALESCKTKEKTNNKISEGNSYLLSENLSRARISVQLSTNQ

SEQ ID NO: 788154 - protein, 109 aa, Homo sapiens [sequence omitted]

SEQ ID NO: 788155 - protein, 78 aa, Homo sapiens
CMQSACNQFAETIFRHWTGIIIILCKIRNQRVIVCVRHDCEKPNSICIEINKKQLRKPYCNAPYSITDSISATHYSIS

SEQ ID NO: 788156 - protein, 45 aa, Homo sapiens
WNGILLHTGNDAMAVDEMGHWGVYLSGGAVINKYLTLGHLYTTEM

SEQ ID NO: 788157 - protein, 228 aa, Homo sapiens
LPKAEAWAMAGAPPPVIVAALQLISDCCASNQRDSLGVGPSEPGVGYSLVVRRFLSRSEKRNIRVGVTRFSSITKAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNK

SEQ ID NO: 788158 - protein, 117 aa, Homo sapiens
ERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 788159 - protein, 107 aa, Homo sapiens
MQSARARAIPAGWGRGTLSSPVQGGGTVVAVKAPPKWHNHPQRPHPPPLPSRGTFVVVGNTDCGETVRIQILALPSTHSITLGKSLNPSLWLSLLICKVDLLINCYK

SEQ ID NO: 788160 - protein, 115 aa, Homo sapiens
CDTESNIILFPPGSWEQYPWGCPLSAICVVISPPPPWNIIKNHVTRGCTLPTMLGVIAFSSSMNIRNKITGWMHTQCYIGSNVILHPLEIIFGSISPAGCAPAAILNVISCSLPP

SEQ ID NO: 788161 - protein, 130 aa, Homo sapiens
RFCGQESGAAQLGHRPLTGCSQGVSRGRTVILRPSRESVCFQARSRGFGHDSVPRGCWTEVTLIFFPRRPLHSSHLCSCFIEASKRDCGKIAVIVLIPEMIPSLGWVFRVEVTSPVRTKWRVWIPGGKDH

SEQ ID NO: 788162 - protein, 74 aa, Homo sapiens
MGQGPYGDSCYGCSVEHVCPTECGVSGGEPEGKLTHAVQTGGEMALRLISGHGGCGGSRDDTAVWLHFTACHAP

SEQ ID NO: 788163 - protein, 107 aa, Homo sapiens [sequence omitted]

SEQ ID NO: 788164 - protein, 76 aa, Homo sapiens
LGGGGGVFPPPFFLKKRAQRGPLGQQNSTPGRLLWASGLAGSSRKGDAVDVCVDGAVFLESVDQIGGGIEVQESKG

SEQ ID NO: 788165 - protein, 115 aa, Homo sapiens
SCLFLQPQTSSPIEVARRAGAVHTLLQKAPGVSDPYRAVVKKPGRWCAVHVQIAWQIYRHQQKIKEMQLDPHKLEVGAKLDLFGRPPAPGVFAGFHYPQDLARPLFPSTGETGVG

SEQ ID NO: 788166 - protein, 843 aa, Homo sapiens
SAQSRRGGHARPRPELRLSRARGERGRLDGPGPPGARAPRPRPCSPAPAPGLVATAWGAGEASVGSEKLFAPGTDKGPALEKSEAKAGPVPKVSGLERSRELSAESFLPTASPAPHAAPCPGPPPGSRANPLVKKEPPAPHRHTPQPPPPQPRGLLPTHVPASLGAFAGHSQAAANGLHGLSRSSSAPLGLGKHVSLSPHGPGPHLSTSHLALRSQAQHQLHAAMFAAPPTLPPPPALPASSLVLPGHPADHELLRQELNTRFLVQSAERPGASLGPGALLRAEFHQHQHTHQHTHQHTHQHQHTFAPFPAGLPPTPPAAPPPFDKYAPKLDSPYFRHSSVSFFPSFPPAIPGLPTLLPHPGPFGSLQGAFQPKVSDPYRAVVKKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 788167 - protein, 500 aa, Homo sapiens
SCLFLQPQTSSPIEVARRAGAVHTLLQKAPGVSDPYRAVVKKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 788168 - protein, 433 aa, Homo sapiens
SSVQGELQLRASCCFRWVFAASSAHTSSGTLLPLSGENPSPAGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 788169 - protein, 843 aa, Homo sapiens; identical to SEQ ID NO: 788166

SEQ ID NO: 788170 - protein, 843 aa, Homo sapiens; identical to SEQ ID NO: 788166

SEQ ID NO: 788171 - protein, 72 aa, Homo sapiens
TAAFKAPEVEAGHRNTAAGAATPALPHTHTHTHKITAVCFLPPEASASPRCGRRLPGPWPGLLSVWVLPSPT

SEQ ID NO: 788172 - protein, 891 aa, Homo sapiens
SAQSRRGGHARPRPELRLSRARGERGRLDGPGPPGARAPRPRPCSPAPAPGLVATAWGAGEASVGSEKLFAPGTDKGPALEKSEAKAGPVPKVSGLERSRELSAESFLPTASPAPHAAPCPGPPPGSRANPLVKKEPPAPHRHTPQPPPPQPRGLLPTHVPASLGAFAGHSQAAANGLHGLSRSSSAPLGLGKHVSLSPHGPGPHLSTSHLALRSQAQHQLHAAMFAAPPTLPPPPALPASSLVLPGHPADHELLRQELNTRFLVQSAERPGASLGPGALLRAEFHQHQHTHQHTHQHTHQHQHTFAPFPAGLPPTPPAAPPPFDKYAPKLDSPYFRHSSVSFFPSFPPAIPGLPTLLPHPGPFGSLQGAFQPKVSDPYRAVVKVSTCWEGPWQGRTLVPPGRPRGARDSRSLQKTWVGVAPAPLSASILSQKPGRWCAVHVQIAWQIYRHQQKIKEMQLDPHKLEVGAKLDLFGRPPAPGVFAGFHYPQDLARPLFPSTGAAHPASNPFGPSAHPGSFLPTGPLTDPFSRPSTFGGLGSLSSHAFGGLGSHALAPGGSIFAPKEGSSVHGLPSPHEAWNRLHRAPPSFPAPPPWPKSVDAERVSALTNHDREPDNGKEEQERDLLEKTRLLSRASPATPAGHPVSGLLLRAQSELGRSGAPAEREAEPRVKESRSPAKEEAAKMPARASPPHSKAAPGDVKVKEERGEDEASEPPAGGLHPAPLQLGLGRERLGAPGFAWEPFRGLELPRRAFPAAAPAPGSAALLEPPERPYRDREPHGYSPERLRGELERARAPHLPPAAPALDGALLPSLGALHFPRLSPAALHNGLLARTPPAAAALGAPPPLVTAAGPPTPPGPPRSRTTPLGGLGPGEARDYSPSRNPPEVEAR

SEQ ID NO: 788173 - protein, 843 aa, Homo sapiens; identical to SEQ ID NO: 788166

SEQ ID NO: 788174 - protein, 843 aa, Homo sapiens; identical to SEQ ID NO: 788166

SEQ ID NO: 788175 - protein, 79 aa, Homo sapiens
EAIAGACSRSWESICASIPAEMQRRAVWVLWYQPTRTGPAGTGSGRSVILLAGDTCRQPTGWEEGQTVVAKHQHAGGLF

SEQ ID NO: 788176 - protein, 96 aa, Homo sapiens
MCGPDRYLTLRAEIQASLAAFLPHPSVLLVPRWELAEMSPGWALTLLFCSLGGLAPDHSSLQQPLDPESTPHSSARPERPAATDAGGGYRVEAALV

SEQ ID NO: 788177 - protein, 214 aa, Homo sapiens
ANRLKILGQSCASLFTWMESFKEGIGMLVCTGEPQDKHKFPKHQKEQLRCLQALSWLTSSDLLAAIISSMAELQDVIGKADPNSRICGHLLIGAAKNSFAKLMDKISLVMECIPLHSSRSITYVEKDSLVQRLAHGLHKVNTLALKYGLRGHVPITKSTASLQKQILGFTQRLHAAEVERRSLRLEVTEFKRSVNEMKKELDKAQGLQMQLNEF

SEQ ID NO: 788178 - protein, 143 aa, Homo sapiens
FLFVHIYGLHEKLCYMFIMHSDQVRAFRVSHCTPGQPQGSPWASGSLSGVSSQGILLSKGSLAYTEGVQSRTHSIDLTWELIRNPDSQANPRPTELESLGERPGIWVLTNAAGDSDARWRTTGWTKAAGLEVSPFDPQSLTIL

SEQ ID NO: 788179 - protein, 139 aa, Homo sapiens
PWCWRGWRAGRRGLRRPRRPWRGRRRFRVWGARVPALGARRIFRLGRPWAWCCRLGRRHPAISPLPGSGREPRQPRARPPRTPGANSLLRASCSFPKPEVATPPPLRAAVRSNHVPTPAGPCKRCDVGLRRPRLLIMGT

SEQ ID NO: 788180 - protein, 118 aa, Homo sapiens
WPASLLIITINYQHWSSGCGKCKTVLLGHHLKPGLLGEIPCGSLHLFNSFHSCFLTPFVVLRQQRCPLAGNPEDEVGTLGLSLVKCHLLSPPPFLALSTHMGMFNDILLFPSFRPWEQ

SEQ ID NO: 788181 - protein, 105 aa, Homo sapiens
MYLVISTSKNFAIGVTNVFWLPGMFPPLLGSQMFGMRKTVCPRCQQPAHTCWATLPPTKGLDQWCAPQQRTLKAKVICSCRYHVKGPVRGPAVEFVEDNIQNILG

SEQ ID NO: 788182 - protein, 128 aa, Homo sapiens
SYHVVQAGLQLLTSGDPPTSASQSAGITGMSHWAPHGAVVNGVGKGGEQGSAGEGQRQREDAATRGGKRSWLVGNQFLEEANVCVCLFLFSDRETGFCFVTQGRVQCRKHSSLQPQIPRLKGSSCLSL

SEQ ID NO: 788183 - protein, 85 aa, Homo sapiens
TKGTCYLDQVEVSYCSGYCPSSTHVMPEEPYLQSQCDCCSYRLDPESPVRILNLRCLGGHTEPVVLPVIHSCQCSSCQGGDFSKR

SEQ ID NO: 788184 - protein, 318 aa, Homo sapiens [sequence omitted]

SEQ ID NO: 788185 - protein, 118 aa, Homo sapiens
AAMSTASIKSAVVPMKVQQGWGFQLLAGLFLECCLDEYSLNIVCYTMRFCVHFSIISMRLKKARMNLSCVSPVCVYVSLCVGRHSLRQRLWTECVSLNSVCRRPNPQGMVLGGEAFGP

SEQ ID NO: 788186 - protein, 209 aa, Homo sapiens
KKIVVRMCCRPALNMLFAPPGALYAEVPVPSSLMPDTDQGFLLGRAVSTALVAPVPAPDNTVFEVRLERRASSEQALWLLLPARCCLALGLQPEARLVLEVQFQIDPMTFRLWHQAVDTLPEEQLVVPDLPTCALPRPWSVPPLRRGNRKQELAVALIAGWGPGDGRRVPPLLIYGPFGTGKTYTLAMASLEVIRRPETKVLICTHTNR

SEQ ID NO: 788187 - protein, 66 aa, Homo sapiens
PAVLHPLLFCLTLAIWISSSYLWLRLHPSPLTTSLLSQAGVCLPASRIPRCAHHHLCSGPDRREKA

SEQ ID NO: 788188 - protein, 118 aa, Homo sapiens
RPAVFCCLSGARTFPRSSQQPAGLCSTVTMCDRKAVIKNADMSEEMQQDSVECATQALEKYNIEKDIAAHIKKEFDKKYNPTWHCKKNRNFGSYVTHETKHFIYFYLGQVAILLFKSG

SEQ ID NO: 788189 - protein, 190 aa, Homo sapiens
MEPEAAAGARKARGRGCHCPGDAPWRPPPPRGPESPAPWRPWIQTPGDAELTRTGRPLEPRADQHTFGSKGAFGFQHPVRVYLPMSKRQEYLRSSGEQVLASFPVQATIDFYDDESTESASEAEEPEEGPPPLHLLPQEVGGRQENGPGGKGRDQGINQGQRSSGGGDHWGEGPLPQGVSSRGGKCSSSK

SEQ ID NO: 788190 - protein, 183 aa, Homo sapiens
KARGRGDHRGTEKPGLLTSHIRQGKPSSPAPWRPWIQTPGDAELTRTGRPLEPRADQHTFGSKGAFGFQHPVRVYLPMSKRQEYLRSSGEQVLASFPVQATIDFYDDESTESASEAEEPEEGPPPLHLLPQEVGGRQENGPGGKGRDQGINQGQRSSGGGDHWGEGPLPQGVSSRGGKCSSSK

SEQ ID NO: 788191 - protein, 106 aa, Homo sapiens
MSKRQEYLRSSGEQVLASFPVQATIDFYDDESTESASEAEEPEEGPPPLHLLPQEVGGRQENGPGGKGRDQGINQGQRSSGGGDHWGEGPLPQGVSSRGGKCSSSK

SEQ ID NO: 788192 - protein, 106 aa, Homo sapiens; identical to SEQ ID NO: 788191

SEQ ID NO: 788193 - protein, 64 aa, Homo sapiens
MQSKRKCKSVVHQLSVTLEDLYDAATRKQALQNNVLCDRCEDRGGEKKKEQYSAVIIAKVLECK

SEQ ID NO: 788194 - protein, 65 aa, Homo sapiens
LSPRCKLGWGREDPGSRAVPSESDYMGCVLGQAQKHGHEVTQGLEGQWAARVGLERLSGELAGEL

SEQ ID NO: 788195 - protein, 68 aa, Homo sapiens
RVDLDATQPAIEKLGPPSQGQGHTSAITTHKQRSMYELGQDTRNYLMIAPEEAAAGAQPSLFPATPKL

SEQ ID NO: 788196 - protein, 91 aa, Homo sapiens
IRTGKRKKKAWKRMVTKVCFVGDGFIRKPPKYERLIRPMGLHFKKAHVTHPELKATFCLPILGVKKNPSFPLYTTLGVITKGTVIEVNVSK

SEQ ID NO: 788197 - protein, 125 aa, Homo sapiens
MLTANITCLSDILCTSSHQLQEAETKRLAPVTELEIGQDKVQSEDCQIQNWNFFFFFFFLRWSLALSPRLECSGMISAHCNLHLLGSSDSLGTTGARHHAWLILVFLVETGFHHVGQDSLKLLTS

SEQ ID NO: 788198 - protein, 315 aa, Homo sapiens
AKEKEQSPTAEKDEDEENDASLANSSTTTLEDKGPGHATFGREATKFEEEEKPDKAWEARPPRESSDVPPMKRNNWIFIDEEQAFGVRGQARGRGRGFREFTFRGRPAGGNGSGLCGGGVLGARSIYCSSQRSGRGRGLREFARPEDCPRAKPRRRVASETHSEGSEYEELPKRRRQRGSENGNEGSLLEREESTLKKGDCRDSWRSNKGCSEDHSGLDAKSRGPRAFGRALPPRLSNCGYGRRTFVSKESPHWQSKSPGSSWQEYGPSDTCGSRRPTDRDYVPDSYRHPDAFGGRGFEDSRAEDKRSFFQDEHV

SEQ ID NO: 788199 - protein, 108 aa, Homo sapiens
MQKIGKKKSGAFAVKISENVEGTLVLGDGQRLEEFGELRRIWEIRESLKLPCDSLNDCDQNADSNMDSEIHAEEVSDANEELIGNQSKGHAWYALAKNLAAFCFCPWD

SEQ ID NO: 788200 - protein, 113 aa, Homo sapiens
KQRFPLLNKIIQVLKVLPTSTACCEKGRNALQRVRKNHRSRLTLEQLSDLLTIAVNGPPITNFDAKRALDSWFEEKSGNSYALSAEVLSRMSALEQKPALQTMDHGTEFYPDI

SEQ ID NO: 788201 - protein, 113 aa, Homo sapiens; identical to SEQ ID NO: 788200

SEQ ID NO: 788202 - protein, 113 aa, Homo sapiens; identical to SEQ ID NO: 788200

SEQ ID NO: 788203 - protein, 106 aa, Homo sapiens
TLEIPPEISGTTATAFIDTVLCGIIGLHMMLSYLFCAKFISVFFSIVGFTWLQFIRNSHTNGGGTETTWVHLDIIIRYPNIPGQACKTFSIIINTKPKRLSLYVNF

SEQ ID NO: 788204 - protein, 90 aa, Homo sapiens
LVGGGCGAAVSASRPCGLLGMRQHSYTFQGGFSCSVSGKEEEMLQLPQYFCLRQSQGSGISKELGIEGLSWPHPALHLTSKAGCFLLLAE

SEQ ID NO: 788205 - protein, 160 aa, Homo sapiens
MCPPSPLIHRTSSFSPNLLPVPEMDLLSDISEEDPFGEADQITLDSLEHLSTGEISEQGDSEVAMPDLVLDSAIAPSQPDCPSPIHGKTLKAADDSDSEFGYFSFSFSKCFPSGFPSLLDEDGYLAFPSLPKVWVSFLPAGVQHYVPITSPSFIPSLILI

SEQ ID NO: 788206 - protein, 108 aa, Homo sapiens
RVRTQAHSRLSPLLCPAQRSHHTWQCGYGVRSENSSSGPGVVYNCTTRAGLFCLPLLQHEPLGKRVLLTSALSSLSSALKMEEEPGISRTPWQNFLHLVTAWATCYSE

SEQ ID NO: 788207 - protein, 124 aa, Homo sapiens
GGSLVEQERLGILLRLRGQTPTPALSAQHRHPRLSRLPLLFPSPSVDEGACRSRLGHGPPRPRTQRGPGAVAHTCNPGTLGGPGGWITRSGVQDQPGQDGVSTKNSKISWAWWLGACNPSYSGG

SEQ ID NO: 788208 - protein, 40 aa, Homo sapiens
MSLRRSQGHSHFCPTGFKFNDSYDPLRFSHSLEQLTELKK

SEQ ID NO: 788209 - protein, 155 aa, Homo sapiens
MLCCLEISCVRYLKSSLSSSKFHRSVGNSRKKFLFSLFPAYLMPVSNTGAQCLQCLCIVRVTLLHFPTNSSSASETTSAWTLLSISLLTFGSKPFNKSRGSSKLSHIFLSSSEPSKLFQPLPVTHFQSCFHIFGYLYSSTPLYWYQLIVLVCSHT

SEQ ID NO: 788210 - protein, 135 aa, Homo sapiens
MSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPLED

SEQ ID NO: 788211 - protein, 216 aa, Homo sapiens
MSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 788212 - protein, 216 aa, Homo sapiens; identical to SEQ ID NO: 788211

SEQ ID NO: 788213 - protein, 602 aa, Homo sapiens [sequence omitted]

SEQ ID NO: 788214 - protein, 241 aa, Homo sapiens
MLLPLLLSSLLGVLSFTPRPQDHNTDLTCHVDFSRKGVSVQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPTREPEKDGIPKGQDQDKHPVNKPKRETGTAIQRHPKGHGKGAQKTHVGREVTWRVDNNQSEAPPKPRLEDRKAPERRNQGYHRT

SEQ ID NO: 788215 - protein, 697 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSVQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 788216 - protein, 112 aa, Homo sapiens
LGRDPGDSLWAEQRGLSGTPAAQESPTTVSVPALTQKPDVYIPETLEPGQPVTVICVFNWAFEECPPPSFSWTGAALSSQGTKPTTSHFSVLSFTPRPQDHNTDLTCHVDFS

SEQ ID NO: 788217 - protein, 111 aa, Homo sapiens
VVNVAVCHREVQQGTNRWVHFLSMKILPKRRTQTETPRPRFSRHSTILDYINVVPTAGPLVSVWAMLPLFLFSKADIPLSDFCTPCLSDIKVGKAPIVLNSNPAWHLLAMR

SEQ ID NO: 788218 - protein, 106 aa, Homo sapiens
RDTACFSPKELARTVGRVWGKWCDAGLAWDPVRGGNGSKSLMFLAPLGKLKPAFSVVYWPRTEVSPFPLRIAGWARGCSSAVSKNRLSGERAGLSQPRAGSELQEI

SEQ ID NO: 788219 - protein, 288 aa, Homo sapiens
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGDLEGTSGSDGNVEDSDQSEKEPGQQYSRPQGAVGGLEPGNAQQPNVHAFTPLQLQELERIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 788220 - protein, 69 aa, Homo sapiens
MVLSLTEEVKEEEEDAQPEPEQGTAAGEKLKSAGAQGGEEKDGGGEEKDGGGAGVPGHLWEGDLEGTSG

SEQ ID NO: 788221 - protein, 87 aa, Homo sapiens
TCPRRRIPNYPLPLMTNAVMIRLSSEGGGGINSLQRGTWMKITSNLLTILRDHSISVTEPNKQVARIQQVLHTHELKMAVYRLSKRW

SEQ ID NO: 788222 - protein, 101 aa, Homo sapiens
GPHAQFGPHAQFMASALFTWAKGQDPVSKSKKKKSLSSAFNSEQKNSSSQEQSASTQLLIYLSQEYGKPQSMVFRHKGRNHQVVEHVKEPRALLSLTRIPT

SEQ ID NO: 788223 - protein, 96 aa, Homo sapiens
MSHSRRAAPTQDQCHTPGFPTSRETSGSIWQARICGSLQALDTWRTHIPRKSPAPTQASQICLLLPESPWRNPTPRGFLKPLINWDAILYFKEKRN

SEQ ID NO: 788224 - protein, 728 aa, Homo sapiens
LIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLQELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPMGGVPEDLPEDCKEELLEKGKRKGANKRRCFLRNLDAQKVFPLVKLPIEKSPCPSGNWQPREQTR

SEQ ID NO: 788225 - protein, 430 aa, Homo sapiens
ARYEAGCYSAEAEVCSEVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLQELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDRQEDG

SEQ ID NO: 788226 - protein, 743 aa, Homo sapiens
LIFHKGLHNLRNYSSDLGKQPKKVPKRRQAARELSIQRRSALNVRLFLRDFCSEFLENCYNRLMGSVKDHLLREKAQQHDETYYMWALAFFMAFNRAASFRPGLVSETLSVRTFHFIEQNLTNYYEMMLTDRKEAASWARRMHLALKAYQELLATVNEMDLSPDEAVRESSRIIKNNIFYVMEYRELFLALFRKFDERCQPRSFLRDLVETTHLFLKMLERFCRSRGNLVVQNKQKKRRKKKKKVLDQAIVSGNVPSSPEEVEAVWPALAEQLQCCAQNSELSMDSVVPFDAASEVPVEEQRAEAMVRIQDCLLAGQAPQALTLLRSAREVWPEGDVFGSQDISPEEEIQLLKQILSAPLPRQQGPEERGAEEEEEEEEEEEEELQVVQVSEKEFNFLDYLKRFACSTVVRAYVLLLRSYQQNSAHTNHCIVKMLHRLAHDLKMEALLFQLSVFCLFNRLLSDPAAGAYKELVTFAKYILGKFFALAAVNQKAFVELLFWKNTAVVREMTEGYGSLDDRSSSRRAPTWSPEEEAHLQELYLANKDVEGQDVVEAILAHLNTVPRTRKQIIHHLVQMGLADSVKDFQRKGTHIVLWTGDQELELQRLFEEFRDSDDVLGHIMKNITAKRSRARIVDKLLALGLVAERRELYKKRQKKLASSILPNGAESLKDFCQEDLEEEENLPEEDSEEEEEGGSEAEQVQGSLVLSNENLGQSLHQEGFSIPLLWLQNCLIRAADDRQEDG

SEQ ID NO: 788227 - protein, 715 aa, Homo sapiens
MFSETVINRIFTSGLAGRLGGRKGRVEGWVAHQNGDELAKQTMLLFLYPLKPISQGFKLTPGVCFTSGLAGKLGGRKGKVEGWVAHQNGDEPGKTTMLLFCIPLKPKQFNDAFVCFLIGSQISFSIKNWGYPKETKSQLTAGGTEAMFFPPFLDSNLTFVGYKHFLQHSELTRVPYKLPSPGGQSYFLRQAQSSNSPNYHYKQSFREETYTLQKLQVRDQNHVTASSSVPKSFTKWDSLSFFFFFFLRRSLALSPRLQCSGGISAHCNIHLLGSSDSPASASRVAGTTGACHYTWLIFVFLVEMGFHHIGQAGLELLTLDPPASASQSAGITGVSHHDQPSTLLIYKGTRRTNYLINLKVRGIIFSDAPTRLLTSLKGYQLKTRVSEAECKNMVKCETALLEAGFVKGCWPPKESMPKLSGLPGPVVTQANLMHRQQYLLGTAANVPQFTFFLYLKISNVSFLGDIPSDTETQLLRMVKSPLQNSRNSTEDDSRVLSHFSKLGRCPDGGKAEPLTCTAPYPGSLCSLEEIGSIQQDSEEMTATSTEQYELPTSTGQSDLFHSLEETEEPFALFNHHSIISSLPIAAGVNCPTSVLCFVKMRVIFCNADGTRMKLYYQLQRQPTLISLKAKIHSTVISPGISCNSKSALDIREYENHTVVAKITLWLLNPFCELKKVNVAEAKLFFFFFFKDEDADSNKGIKKVLDENEKYVKDNM

SEQ ID NO: 788228 - protein, 103 aa, Homo sapiens
FLAFDRSSKGPAALGRPEFASVLDASCEKLHGPGGETDMWPQQEEEAVLRAGRGFLGSLPGLGSWAEDFLSWHADPAGQVGKHGAPCLASLHQLEGTTQTLLE

SEQ ID NO: 788229 - protein, 82 aa, Homo sapiens
EEVKCHILPGPSVSRSPESYSETFKGPSERTLRTTVMDKPSEAFPCDSHCTLIHWLSAQGQLQQGTQPELREIQVWAVDQRC

SEQ ID NO: 788230 - protein, 259 aa, Homo sapiens
GLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAPSLGTADRPEPENQWYLFNDTRVSFSSFESVSNVTSFFPKDTAY

SEQ ID NO: 788231 - protein, 603 aa, Homo sapiens
LSHRPGPTVAPQSKEGKKGPRLPEKETLLSLPAKDTPPGVPEKSLGGSSLTETEAAPSLTLPSVDYIPQDSPTPSVRQIRNELEARLSSAAEKEAKPSIGSLPPKPRLEGGRICENGADDDKLSKPVAKNLPPQSTTLLPTTSLQPKAMLGPAIPPKATPEPAIPPKATLWPATPPKATLGPATPLKATSGPTTPLKATSGPAIASTATTLPTTTSQLMAEKDSGPAGQPEKPASQEVSTPSQARGEGSPSEATRLPTQGARSSAAFPPKTSPGGGEVPCLYKPHCHQSSLSREVAVVMPTLARGGAAGPGEPVEVKEPPGLPAKPPASAQPTDELLRHPVTGEVVERGSPMALLLAARQRAQKGRSVGAALGRSSLPGSLRDHSHQAEASSDSIFHSQGTPNSFTVVPKLPKEAEKDSPLTTEIPNKWGPRLGRDAEGTELSRRHNWTKPEPQAPVAWERVAPSNLPQGHPLPKSFSSPPSPSNKREEEEEEFNFEVIPPPPEFSNDPEPPAPALQYLGRQSSPPRNNYSDLRQLPNAGPGAPPALGFSRFPAGARYAGAGGLERFSGGGRSLIKKRLYVGEPHRGPGLPHGGTGRSLSSPN

SEQ ID NO: 788232 - protein, 553 aa, Homo sapiens
EKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQE

SEQ ID NO: 788233 - protein, 216 aa, Homo sapiens
IVIRYVDYEVPSQLQNHMMKHKDIRPYICSECGMEFVQPHHLKQHSLTHKGVKEHKCGICGREFTLLANMKRHVLIHTNIRAYQCHLCYKSFVQKQTLKAHMIVHSDVKPFKCKLCGKEFNRMHNLMGHMHLHSDSKPFKCLYCPSKFTLKGNLTRHMKVKHGVMERGLHSQGLGRGRIALAQTAGVLRSLEQEEPFDLSQKRRAKVPVFQSDGES

SEQ ID NO: 788234 - protein, 60 aa, Homo sapiens
WRRGPGWGAWRRRPGSRLFQTTQHPAGGQGLDGATHACPRPSPGSDSQPPPIEGAPELSL

SEQ ID NO: 788235 - protein, 75 aa, Homo sapiens
QSVIKAQLSSPLVAEYLSGAHWRGAGDLTVPIKTATAIFCASRTGVIIRAVHTVGTKSSHFSIWHSSSLDRHGQQ

SEQ ID NO: 788236 - protein, 83 aa, Homo sapiens
LSHKDLLPDSLTCIGYKLGSHAGGSLGRGMLSVYWSTYDEAELVLRDEPCAGLKRSMPTLIIPHISGRLIYDSRTVAMEVGIR

SEQ ID NO: 788237 - protein, 114 aa, Homo sapiens
MATPLDNCLRPFPDPMVKVTAETKKISEVSSYVSANNKKNSFWGSGLLYPVALLRCQDCWAGHQTHVLKRVSHYVAQAGLKFLASSNLPTSASQSAGTTGTCHHAQPQVFIPIP

SEQ ID NO: 788238 - protein, 108 aa, Homo sapiens
LALFLLLFGDLHCQNYQFQVNFVGEFPPPPSSGSPRSNVPPATFPLWPPAELICLSHRSWCLPLHRSLNAATLAGSRWKLVEGPCQVTAMLSLSRHGPGSFRHIQILH

SEQ ID NO: 788239 - protein, 74 aa, Homo sapiens
VSSLSLTHISHRQRRQSICLRNASTQLPSSLAALPDSKDSRLRRKQKEGGWVQRLMPEIPALWEAEVGESTSRT

SEQ ID NO: 788240 - protein, 118 aa, Homo sapiens
QQLYRLTSYSISVLLHLLYHSLSLHVSSESFGSKLKILWTLIKRFILQCVFPKNKDTFLCTHTIWIKIRTLSMDTVPYSNPQSIIPVLSVVPIISFIAIFFIVQNHALHLVIMSLGFF

SEQ ID NO: 788241 - protein, 88 aa, Homo sapiens
GAFYHFEFCFGNPVIGGVCGNHQYLETAWEIHSFIHPVQTGHTHLQATARDAGGAESWSVCSGGEAGAELNDPTVDLQMAKGAVREID

SEQ ID NO: 788242 - protein, 67 aa, Homo sapiens
MGCPHCLQFTLHCPLPLAYPGQRLQAPVSKDVAGFMSRYCLKRHLSTASFTLATPTSTQQSPCCSPK

SEQ ID NO: 788243 - protein, 125 aa, Homo sapiens
MSSFSRNSGSISQGPEKPQPTNRTSALQYVHPPSWLLGAARTLRICLCRAGRGNKPDSGLTEAQGGVQEAASGLPMQPQPQGGPEQPPFRSFPPALPPSCLREFWNPKQRCPAQGRPAWGSDLWG

SEQ ID NO: 788244 - protein, 796 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 788245 - protein, 552 aa, Homo sapiens
MHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 788246 - protein, 769 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 788247 - protein, 796 aa, Homo sapiens; identical to SEQ ID NO: 788244

SEQ ID NO: 788248 - protein, 393 aa, Homo sapiens
MPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 788249 - protein, 773 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRMFLRREFPWKFNWNNFDHSLTYKPIAVNCEHTCF

SEQ ID NO: 788250 - protein, 780 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKSVGKDKKAIQASIRRNKETNTVLARLNSELQQQLKDVLEERISLEVQLEQLRPFSHL

SEQ ID NO: 788251 - protein, 579 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 788252 - protein, 455 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPVSQSLSLLV

SEQ ID NO: 788253 - protein, 80 aa, Homo sapiens
VPYEVTADNNSSSRQKKYTYAKTTVVKHICSKGTTPLAPPPKPVRRRLKSEDELRPEVDEHTQKTGVLAAVLASQPSIPR

SEQ ID NO: 788254 - protein, 830 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSAALMLLMMSGAEQNPQEGGRVDTVFQQEARLEHCINVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 788255 - protein, 796 aa, Homo sapiens; identical to SEQ ID NO: 788244

SEQ ID NO: 788256 - protein, 232 aa, Homo sapiens [sequence omitted]

SEQ ID NO: 788257 - protein, 550 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSVFLSMKSMLNYLAAF

SEQ ID NO: 788258 - protein, 576 aa, Homo sapiens
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGRG

SEQ ID NO: 788259 - protein, 37 aa, Homo sapiens
YGRQAPGGKQLPGVSQLATKQQSQDSGPGANTRPGPY

SEQ ID NO: 788260 - protein, 39 aa, Homo sapiens
MQSNTLRRSRAAWPRLVLWGSILRTVSQKMGLGARKKKM

SEQ ID NO: 788261 - protein, 103 aa, Homo sapiens
RALLVRMPVQSAHLGVGLFPGCRPPCAFTSLTLPLLKLGSSREVDKLLSLIIFSQAFKGNHYPGEQGHCGFCFREVLRGSKLQLCDSEQVTQPLWARVSSPST

SEQ ID NO: 788262 - protein, 110 aa, Homo sapiens
EWVAVFSTNHAGLGHLKAFSSAWLVLYRGVGSRCGESIGTIELAMRTDFTKREISHTPISASKVIYFKSFICILVCQLHSILLFKPSRVCNRKVLLQPDIHKPNWSFSLV

SEQ ID NO: 788263 - protein, 898 aa, Homo sapiens
QPVAARRRRRRRRRRRRRLPPASPPSSSVSSSLSPSAVVMACRWSTKESPRWRSALLLLFLAGVYGNGALAEHSENVHISGVSTACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 788264 - protein, 879 aa, Homo sapiens
QPVAARRRRRRRRRRRRRLPPASPPSSSVSSSLSPSAVVMACRWSTKESPRWRSALLLLFLAGVYACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 788265 - protein, 831 aa, Homo sapiens
VLAAGKSSIEALADLMSACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 788266 - protein, 101 aa, Homo sapiens
MGGEAGWGGRLQRGEGCTISKEFGSRGPAFLRRAPPASWLPSPRPICTPGPGCAARGVSGPVEPAPRCAARRLTVRTGGRCGGATIPCPTPPGVWRRTWRP

SEQ ID NO: 788267 - protein, 86 aa, Homo sapiens
QTPQSGEGEEKKKEKEEEKKGGGGEEERRRKKEKKKERRRTKKKKERKKKKEEGEEEGEGEEERKDDREDNINIFKYHVISKRTGF

SEQ ID NO: 788268 - protein, 79 aa, Homo sapiens
IRLCESNFDRGQTTSLENKNSKTTTHRNHENKNITICQNPFVWIEQVYTNKLKNEKKFILQTVKVPLLKNGSIFIFNYL

SEQ ID NO: 788269 - protein, 143 aa, Homo sapiens
RLHGMGSVTREKMEHGRDSMARGQRGSHRLPEEQWGERFPCLPLGSAEKEQWPWRLCFMLPAAFVAGTSYGHREKLLFPKHYANSTVTTRNTSPVKTPPAPPATKMQTNPRCSCVLISLQPTVLDWDTRFGKSVCFVSALPLL

SEQ ID NO: 788270 - protein, 121 aa, Homo sapiens
QPSLFLISFLLEGSFFFPELFSGRHWELSHPPTPVQDIFYSSAKRISLNNDFDPIPPLWEIPWELPTACGLSPSPHTGQIPFGLACAPLRHTSCLEQCCVSRNVAASAHIHTPPRILGSLF

SEQ ID NO: 788271 - protein, 126 aa, Homo sapiens
QANRILPISTLHLSFINYSASYTIKVYHNHHPIILFHPQHQSCWLAQSCWLATYLKQPPWTCPFISYFIPTPYNNSVSALRGGGQLTVTHPLRMQSQVCQLQDRLSDPTQQNTGEQFRMTLCSWRP

SEQ ID NO: 788272 - protein, 101 aa, Homo sapiens
YCLAIQQLYDTHKNPQGLVCAVSLAAPTATGPRPILLEVLLALPMWRFFPTHLGGLDLLHKAADVFPTGSCQLSQGPMHWHWGLAERGEQDGPAYLRQPNL

SEQ ID NO: 788273 - protein, 69 aa, Homo sapiens
ACVEARGVGDCGHVLEGASETSGKPFLPTRSLPLCLTIFHRERCHKEEMEFSGKSGGLGDKRSGFAPWL

SEQ ID NO: 788274 - protein, 102 aa, Homo sapiens
SASQSAGITGVSHCARPKRKEILIHAAAWVNFDDIMLSETRLSQKDKYYMMPLTSVTFSSQIQRQEVESWLLEKGENWELLFSGYSIPIWENKVLEFGCTTV

SEQ ID NO: 788275 - protein, 102 aa, Homo sapiens; identical to SEQ ID NO: 788274

SEQ ID NO: 788276 - protein, 73 aa, Homo sapiens
DHVYSFLVIPYNYKFKEMQKDEYLVHFNINTKNCYITKNLGRVQWLLPVIPAIGITGLSHLAQPALRLLQPMV

SEQ ID NO: 788277 - protein, 71 aa, Homo sapiens
MTAPTSGNILHAQCWAQNKRGSHLADGETDPISSVTNTLEAGVVPSVLGWPVLQPGDTVGIQPPPPPQGWS

SEQ ID NO: 788278 - protein, 273 aa, Homo sapiens
NNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGLCCKILWSNCDVSTVLRFLADRFVEGVCPFCGYEEARGDQCDKCGKLINAVELKKPQCKVCRSCPVVQSSQHLFLDLPKLEKRLGGTWSGRTLPGSDLYHPNAQVLIDPVLGSSRMWPSKANAWINPETFKWGNPCVNPFRQVLDRTGYFLMVLVDAIMAYLAHPTAISRN

SEQ ID NO: 788279 - protein, 84 aa, Homo sapiens
MEDSSYDNHLEGDDPEREVGHISREETRYKEKRRDEVSLVEYSWGRISHLQESLHLPFLPILVATCIYSFPSSHPSLCPAFSIH

SEQ ID NO: 788280 - protein, 67 aa, Homo sapiens
SHCNWRPSGGRDQEEDAAQSPGPSIHRPLEMAWSPVASGLQGPSEVLIKPGRHTMLVKAGFVDAGLN

SEQ ID NO: 788281 - protein, 98 aa, Homo sapiens
AWPPSLYAHQTILCSGAQGVGLGAWDPWLLSASSQQWLATASKGQGPISSRSHSPVGLCSITPPWALLPMLLEVPFLDWHLLRHNHQGLNQLISKVPR

SEQ ID NO: 788282 - protein, 48 aa, Homo sapiens
PRQQGGEWGNKITTKSLGVSHSPSPGTLSETLQSPRNSLREAGRRPAI

SEQ ID NO: 788283 - protein, 130 aa, Homo sapiens
IFLLSVVSHSLPKSVCSVYFLFLFLLPSLFVFFPFFPISFLSVCLLFSPIPNLYFSHNSILFPKGGKVHYKDSYKKREIPQRENQERVSTVYKFMLQRLAYFLEVSLRGCTSLYPNFKWDMFVKYVCQTF

SEQ ID NO: 788284 - protein, 50 aa, Homo sapiens
MEGLLCYAKELWQYPAGGRSCRRFVNKEMTTDLYFRKTGCWQCGQWAEAG

SEQ ID NO: 788285 - protein, 119 aa, Homo sapiens
MHAQMNNYHSGALSVPGTVRRVSFIFHLPQWGNSQPLKSEIPSDPAIPLLAIYPKEYKLFRHEDTCTRMFIAALLTIAKTWNQPKCPSMIDWIKKMWYIHTMEYYTAMKRNEILSFAGT

SEQ ID NO: 788286 - protein, 736 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNLSRMDLEMSGLKTLEHVAVTVSITHPRRGSLELKLFCPSGMMSLIGAPRSMDYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 788287 - protein, 601 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNLSRMDLEMSGLKTLEHVAVTVSITHPRRGSLELKLFCPSGMMSLIGAPSRDWIRRFNDGLLHCAMWGKEPRNYRCNKDVGISIQADLARS

SEQ ID NO: 788288 - protein, 118 aa, Homo sapiens
YLPKNGAYMCLLIDSNTLVGVVGSEEILSNSQYYKKFSWTPFGVKENHYNVLVLWEGQEECVSLQAGVEHRFMDLAEHWLLWGNQKLQTSTVVAAEGHYPKWTNARTENQILHVLAYK

SEQ ID NO: 788289 - protein, 103 aa, Homo sapiens
MRRRRPGCPASRHGSVHHRPPRCLCPSLPFKGKRYLFIFLPWTLEISGENSALATKCSGSRMLPSFLPFHMEFIQSTKASHGTDIRGARSPGSGKHKPVLRGP

SEQ ID NO: 788290 - protein, 102 aa, Homo sapiens
GPTHRHGFPWQSPGTGRHGSPHTQHSETFLFPGKIEAFWPHCGPSQGHRGAAHKSDQSKRPRSLAVSGQWLPLCVSQNGCRGSCTLWADWSSGCLADLSRGL

SEQ ID NO: 788291 - protein, 68 aa, Homo sapiens
ITIQRATVTKTAWYWYQNRDIDRWNRTEPSEIMPHIYDYLIFHKPEKNKQWGKDSLFNKWCWENWLAI

SEQ ID NO: 788292 - protein, 108 aa, Homo sapiens
ILQHAAGLHLHNRSMLDHLLLQFAVQVWKHLHFLILRVMLDFSKNPRNSKITQVTVSLQSSPLLSSLFFSFLDRVSLCHPCWSTVAQSGLTATSTSQVQVILLPQPPE

SEQ ID NO: 788293 - protein, 133 aa, Homo sapiens
MQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEVTNTRVQGRE

SEQ ID NO: 788294 - protein, 63 aa, Homo sapiens
YFKNYLSFYSSYMSYLAKNSRKKEDKRAQSPNLTRSAQFPPMLSTLSILMELTIHLHIRVSFK

SEQ ID NO: 788295 - protein, 112 aa, Homo sapiens
MTPILLCFSIVLQHIEESKEILEITHPQSTHFPLSFSSLLFFLSLSLSFFLTGSHSVTLAKVQWYRRLGGRNTECHQRKSLFWKELLNQDLKKQKEPTTQGWFGIEFQADGT

SEQ ID NO: 788296 - protein, 122 aa, Homo sapiens
VWALCPPPSPAVRPRVPFAFNPSRADCLRLLRIAPTWLAERQKSAVAVRGKLFANRRPHPAETPQAGSQKSQSSPNPGSASLSQWDSSGSQFAHLCRRCEEFLHNREKKVWKQPKIILIRNN

SEQ ID NO: 788297 - protein, 107 aa, Homo sapiens
MVLPQGLLTFRDVAIEFSQEEWKCLDPAQRTLYRDVMLENYRNLVSLAWSFSLLLPRLAVQLAQSRLTTTSASRVQAILPPQPQKLLELQVFSSKCDIKELPPKKGE

SEQ ID NO: 788298 - protein, 114 aa, Homo sapiens
GFAPRRHPAQAPPTTSRGPPRPGFCPARADSRKSGSGSRGVTVTPRRINFQRLMLHEKATKKTKEKETRMALPQGCGYRILFGGVEMPEPCTEGFIQGRDVAELQEPGVCGIDF

SEQ ID NO: 788299 - protein, 234 aa, Homo sapiens
EISEVDCKDALEMICNLESEGDEKSALVLCTAFLSRQLQQGDMYCAWELTLFWSKLQQRVEPSIQVYLERCRQLSLLTKTVYHIFFLIKVINSERWGLTILPRFISNSWAQVILRALAFQKWWDYRYEPPHMTFAAAFLTGIVCTMTEGAGLATCIELCVKALRLESTENTEVKISICKTISCLLPDDLEVKRACQLSEFLIEPTVDAYYAVEMLYNQPDQKYDEENLPIPNSL

SEQ ID NO: 788300 - protein, 293 aa, Homo sapiens
DQLVLIFAGKILKDQDTLSQHGIHDGLTVHLVIKTQNRPQDHSAQQTNTAGSNVTTSSTPNSNSTSGSATSNPFGLGGLGGLAGLSSLGLNTTNFSELQSQMQRQLLSNPEMMVQIMENPFVQSMLSNPDLMRQLIMANPQMQQLIQRNPEISHMLNNPDIMRQTLELARNPAMMQEMMRNQDRALSNLESIPGGYNALRRMYTDIQEPMLSAAQEQFGGNPFASLVSNTSSGEGSQPSRTENRDPLPNPWAPQTFPESHQPPAALQHCGWHYMVVLAVALLGRVLRGPNVLE

SEQ ID NO: 788301 - protein, 127 aa, Homo sapiens
MLLFCEPVPERKVGSLFGSGPSFYYNHFGKKGKRAAVLHSVFLLLLLTQSELRLTMIPSFDLEHITIRGLQFKVQHHSRQNNGLAKDVHVLILRICEQVRLHDVLTALCFPRTHMLKPNPQCVCIWR

SEQ ID NO: 788302 - protein, 102 aa, Homo sapiens
REAALRDICQVGMGGVELQGHHVSHGSPMVALSCLSVILSVLCGPPVTPFRLSFQFSTVPASPLPLSRLSVFSPCSQVLRWPLVLCPLPKTLCRESVKTQRK

SEQ ID NO: 788303 - protein, 170 aa, Homo sapiens
GVMACGPLDPLGRGANGEVVPQCARIRAGWAVRARRRGAQSPRDPQAPGTLGNAPNRPGSEGRGQDSAARLAFDCVRPCSPPTLRPFSPDPRLLSLPPSSGGERILAPREKSMGFVFSFLLFGGLGRGGNPCGRKAPGLGALAATCLIGAPSSHSGKAGSVWFLFFFLSL

SEQ ID NO: 788304 - protein, 107 aa, Homo sapiens
MGKLRPSSFKQQELGNGAECRCPFQIGCSMGQWDMPVVTHVTHSPTCLAPAGSEAGHPDEQDAMCPFNIMWPHTHTYERNQPDTRDGLLYNSVFWFLICICLVISDV

SEQ ID NO: 788305 - protein, 97 aa, Homo sapiens
GSEEPQNSHGPLAHHSCCMEKQPDCLPCGSLSLLLLTGQGLLTWAPSTSTLPPPDYFSQWRLCVSLGWNSQKHLTGSLPLLLQQYQPLLPSGGGTKT

SEQ ID NO: 788306 - protein, 74 aa, Homo sapiens
TKSASPAVYLILANGNSILPVAQAKNLESSLTYPFLLYPTIPSLGKSCGHQLQNLQQTQPLFLVSIPTTLFQTT

SEQ ID NO: 788307 - protein, 123 aa, Homo sapiens
CQILNQLSWSSQVGSGRICINQHFNRRQGAGRAAGTRKGGEALHTDWAGGLLLTSALEVSLDGCLGVHQGSRKKSGKDVPDRSCVAQASLVHSGWLVHWMHEGGKWTAAESFKAWWDMACQEY

SEQ ID NO: 788308 - protein, 78 aa, Homo sapiens
MEKWSQELAETMILGRPLENHTHSKELMMSGAPLESLPMRTLRPPPSMTIAAQRLSRRGTATPHLLASKGLPTHLRVH

SEQ ID NO: 788309 - protein, 68 aa, Homo sapiens
LGVPQRAPHASLKAAGNAAIDQWVLGSSHPRADSLLHGPRSVSHACRCICMGTWGPRSLPTAEFKDAG

SEQ ID NO: 788310 - protein, 59 aa, Homo sapiens
MPPSAFFLFCSEYHPKTKGEHPVQSTSDIVKKLGGMWNNTAADEKQPHEKKAVKLKEKY

SEQ ID NO: 788311 - protein, 115 aa, Homo sapiens [sequence omitted]

SEQ ID NO: 788312 - protein, 81 aa, Homo sapiens
ALWTHPQHSGRGGLLSPGPRSTLGPELSASLLAEPGERKPGPRCRSALSLHPPQHESLSCRPARPFFPLLLSNEAKWVHVA

SEQ ID NO: 788313 - protein, 111 aa, Homo sapiens
YTYTIYTYTICTYIHCTYTFCTCILCTYTICTYIHCTYTLCTYTICTYIHCTYTLCTYTICTYIHCTYTFCTYIICTYIHCTSTFCTYIHCTYILCTYTICTYTICTYIHC

SEQ ID NO: 788314 - protein, 270 aa, Homo sapiens
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 788315 - protein, 270 aa, Homo sapiens; identical to SEQ ID NO: 788314

SEQ ID NO: 788316 - protein, 270 aa, Homo sapiens; identical to SEQ ID NO: 788314

SEQ ID NO: 788317 - protein, 224 aa, Homo sapiens
SFSSSGDLYTTSSQLTLPATQCLAGKSVTCHVKHYTNPSQDVTVPCPVPSTPPTPSPSTPPTPSLLMLPPPDCHVHRRGPRGPALLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 788318 - protein, 270 aa, Homo sapiens; identical to SEQ ID NO: 788314

SEQ ID NO: 788319 - protein, 139 aa, Homo sapiens
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVGLSLRQWCSHLPPHNCAQAGASLSDPAPRDLGGCADRTSSRQFP

SEQ ID NO: 788320 - protein, 160 aa, Homo sapiens [sequence omitted]

SEQ ID NO: 788321 - protein, 160 aa, Homo sapiens [sequence omitted]

SEQ ID NO: 788322 - protein, 320 aa, Homo sapiens
PGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSANSNGTPGELWAGGLGVELKGYYDH

SEQ ID NO: 788323 - protein, 375 aa, Homo sapiens
PGPDGPRRRGRKPTKAKRDGPPRPRGRPRIRPLEVPTTAGPASASTPTDGAKKPRGRGRGRGRKAEEAGGTRLEPLKPLKIKLSVPKAGEGLGTSSGDAISGTDHNSLDSSLTREKIEAKIKEVEEKQPEMKSGFMASFLDFLKSGKRHPPLYQAGLTPPLSPPKSVPPSVPARGLQPQPPATPAVPHPPPSGAFGLGGALEAAESEGLGLGCPSPCKRLDEELKRNLETLPSFSSDEEDSVAKNRDLQESISSAISALDDPPLAGPKDTSTPDGPPLAPAAAVPGPPPLPGLPSAKPGQWLTPEPPAAGGERRAQQLHVLTSESLVSSEVTRDRPIPHNAGEPPDSHKARKANPARTRAAAAKKGGRNREQRKQ

SEQ ID NO: 788324 - protein, 103 aa, Homo sapiens
MSPAPGYRASAHIPWGQVDGTQGHGGGLLTGSRARVWEEGGRCRNLTGLSLTGPRALASLRSSSGQCFSSTLSLGGCVAWGSGLWWRPVCRKAPLPTKRQLPI

SEQ ID NO: 788325 - protein, 76 aa, Homo sapiens
KKMKPEQAWNMLCTTVAGQRLKAKAKPKWLLRPKSCPGQLPHPNLESKIPSCRSGPGPHLVSSSIKGSECRALGVA

SEQ ID NO: 788326 - protein, 94 aa, Homo sapiens
AAAKCALRLRLRGGSTRGGALETSTGFNTAPDEVSSGKGAGFTSLGSPGISQQATTKVFSAHLNRDKTVMKIFAKSPVIRIHVYKERQLLICHL

SEQ ID NO: 788327 - protein, 68 aa, Homo sapiens
QSLFSNCPLSKTHYMTMLATDRGTFPRGFFCELRKQGNSPVIAKIVWLLGSCGYHLGQYFCDLLCTPL

SEQ ID NO: 788328 - protein, 147 aa, Homo sapiens
FFAYQLSTYIKVSQMILVLGISFHSSLATLSCLKLIIIIIKYLWKDYGIHRSVDSGLGTVVHACNPSTLGGRGRRITRSGVRDQPGQYGETPSLLKIQKISWAWWHVPVIPAEGRQENCLNPGGRGCSELKLSHCTPAWATEGDSVS

SEQ ID NO: 788329 - protein, 77 aa, Homo sapiens
RHLNQTQAERIDRVGGGVNSPAPRSHCPARERAAETPRAGQGPGTRVGVDSRAGVVGATLAVQGQSLHAAPPPPPLG

SEQ ID NO: 788330 - protein, 108 aa, Homo sapiens
MTDESQKVWRCWQKTQDSWIRDKRFITHSTANSGPIRMSRQALCEYPSCRNKGQKLEPGSVYCIRDKHYLCCPFCFMISPAMMSEHLSKRHLSQKQLSSHDRLCDILK

SEQ ID NO: 788331 - protein, 265 aa, Homo sapiens
TASNAAGERAHITLGCAADVEAVQTGLDLLEILRQEKGGQRGEEVGELSWGKALFLGAMGGVGCSQRRWMQSAALDAVGGRWMQSAALDAVSGVDAVSGVGCSQRRWMQSAALDAVDCIQPQVQILVVVANIQTRTLKAEVEKGPCEQQLNMGQSVLRDGRAPFRRDGRWPPLPSADRKGVGFRSPNPEWRRWAPRGVQCGNATDPGEAGGSPGETSRFRRRPVSSRWPLKIRGRGCKSRAGPYPYPQQVSKVNSLWHVWTLGTV

SEQ ID NO: 788332 - protein, 114 aa, Homo sapiens
MGQSVLRDGRAPFRRDGRWPPLPSADRKGVGFRSPNPEWRRWAPRGVQCGNATDPGEAGGSPGETSRFRRRPVSSRWPLKIRGRGCKSRAGPYPYPQQVSKVNSLWHVWTLGTV

SEQ ID NO: 788333 - protein, 177 aa, Homo sapiens
MHQRRRCKIVYVLIDDFRLQRRHDAEKLGHFLEHVLGSGMVTDGTMATDQRKVKMLWALRGRITEALSRDGYVYKYDLSLPVERLYDIVTEMRARLGPHAKHVVGYGHLGDGMGERRSEGTGDGLRCPRPIERESGSDPRIRSGGDGRREASSAVTRPIPEKPAGAPGRRRGSGGVR

SEQ ID NO: 788334 - protein, 58 aa, Homo sapiens
GNATDPGEAGGSPGESSLFFVKGRAPWNGFAPREGPVPWKASRFRRRPVSSRWPLKIR

SEQ ID NO: 788335 - protein, 135 aa, Homo sapiens
DTGWFQTHLSDSDIGIGSAHKVTMRSVLGAQSIPGDVSGGLLEFMSFQPLAPVLLIDLPFGIIGTWGHLGTIPVPRHYRVDVALVKNCCSDIYSLAFSKGEKAGIGGVRTGSERRIRGLWAVDANRLRRGSGGVR

SEQ ID NO: 788336 - protein, 114 aa, Homo sapiens; identical to SEQ ID NO: 788332

SEQ ID NO: 788337 - protein, 146 aa, Homo sapiens
LSPIHSSLLWPTRSCVIWPCCSSLYFLSFLELLHSNFNIPQTHQAHCYLRVFILPVSVTKNILLMAHTFISLRSLIKSYFLRADFPHYPTIRNSPQKNHYYLFTLYSLALLFFIILIIVWHYVIYLFIVFSPISFYFCIRSTLNSA

SEQ ID NO: 788338 - protein, 43 aa, Homo sapiens
GRGCCWSPSLTESNRKLIKTHSKLRPVSNEYFYAVFYRNFTSK

SEQ ID NO: 788339 - protein, 563 aa, Homo sapiens
PISGGTCGIGEVLGLVPSLGQSPPKASLSHTAVRACGPRGLSWRLQGGAAFCNPPGPQVTLLLSLDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKYFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 788340 - protein, 709 aa, Homo sapiens
MAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKYFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 788341 - protein, 745 aa, Homo sapiens
AKRLQDRTGPGAGSCTASAPPLRPSAPRRRTPQPPSMAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKYFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 788342 - protein, 440 aa, Homo sapiens
MAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKYFHPYIAYCSNEVYQQRTLQKLIADTRLREAWENESGACGACMVPRTPGGDLVPLRTLLNGPRQGPPAPHG

SEQ ID NO: 788343 - protein, 709 aa, Homo sapiens; identical to SEQ ID NO: 788340

SEQ ID NO: 788344 - protein, 206 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTGNETAPSKKLTDQKSRGLLQSAFV

SEQ ID NO: 788345 - protein, 158 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGGCFNQLLYDIRN

SEQ ID NO: 788346 - protein, 275 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTVCETQLHRLMTKSPLALDTRPWDSQTLLWTPLGSGFCLTFPGGGIRARRAEGLSLPKTRPLFPTQFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTGNETAPSKKLTTKKVEGCFNQLLYDIRN

SEQ ID NO: 788347 - protein, 94 aa, Homo sapiens
MQCFSFIKTMMILFNLLIFLCGAALLAVGIWVSIDGASFLKIFGPLSSSAMQFVNVGCHDCVHVSVLQSTISEISRASVDDVEGTSKCINLLQC

SEQ ID NO: 788348 - protein, 206 aa, Homo sapiens; identical to SEQ ID NO: 788344

SEQ ID NO: 788349 - protein, 206 aa, Homo sapiens; identical to SEQ ID NO: 788344

SEQ ID NO: 788350 - protein, 206 aa, Homo sapiens; identical to SEQ ID NO: 788344

SEQ ID NO: 788351 - protein, 67 aa, Homo sapiens
EEEGLLPNSFHEPNNSDIKTWQRHNEKENYRSISLMSIDGRILNKGLSVVAHPCNPSTLRRRHKRIS

SEQ ID NO: 788352 - protein, 131 aa, Homo sapiens
PGWRPFNLHQILGLKGFFCVCVCFFVFFLNGVLLLSSRLECNGAISAQCNLRLLGSSDPPASASQSAGITGLSHRIWPAVKLSKSIFSFLLSFLVSQRQEYAPPLEVPLIVQSSTENLIICLSDQKQNKCP

SEQ ID NO: 788353 - protein, 106 aa, Homo sapiens
TSARYRMTPRGKGATDLSGTDNGKGSEQIRLPDEKEEWKPKEKQRARGTTLWNSPTSSRRVPGPSSQGGNHDGRRYGGGIKKQPLKHQVGWAQWRKRQIVMNGEHL

SEQ ID NO: 788354 - protein, 186 aa, Homo sapiens
LTLDLFMLGYFQLPEMGLSREDRKFRHLLCYEMFHRLDSHPWERIRLFHRVVLEEVEAGRRGWSDGFEDLRHRFFGNGLEAGPAPEEQAKKKEEKGKEQERTEEAAPVQKGDPPKGQREALAPVPQPPPPPAAPPRISDSPGSEAPAEDPLELVSEMGEFSNEDICRYIDRSFSFWKEKEAELFDI

SEQ ID NO: 788355 - protein, 71 aa, Homo sapiens
LTLDNRLDSQGVLSTPYFPSYYSPQTHCSWHLTVPSLDYGLALWFDAYALRRQKYDLPCTQGQWTIQNRRV

SEQ ID NO: 788356 - protein, 122 aa, Homo sapiens
NAVVFHISHVHPPVYFKLYVAYNTSYSVNAMELYCLGNNDKEKSLYMFSIDTTTRDPLSKQKQKLQRFDYRDPMGPLGLLGCIRVSVDPLYLQAVLSTVSAYIFHIYFLGGQFWASSNSQAN

SEQ ID NO: 788357 - protein, 67 aa, Homo sapiens
PLHPLSHSISEHLDLIDNTCPLRKTLLQRGSLVLWERQFRDSVEPQTSMQISALPSKRFITSSSFPL

SEQ ID NO: 788358 - protein, 36 aa, Homo sapiens
MSFMDTGEKCPRKRQQQVLSLSELRILHLPSSRLSK

SEQ ID NO: 788359 - protein, 73 aa, Homo sapiens
MSLGRRSARHGTLRRGTAGCARDEAGPGQGRLPWEGTLCHGSGDCVGDESAPWTVLRVLPRAQCPRGMLCAAG

SEQ ID NO: 788360 - protein, 101 aa, Homo sapiens
NLNPHFHHPTDLFPSLSELKSLEDPVSQMPSIFLALPLPFLGEITYPHQLKECQMKFSVSLPKLWQPVSPHELRANPHMALYNFLFAKLIFLVYKMICQMY

SEQ ID NO: 788361 - protein, 93 aa, Homo sapiens
LRGLPGFALTLSGMDGGRTAVRGACAERGSLPRYDPGNRIDGRVTCGHVTHEFGSAEASLQASACKKKKRKDKKRKREEDEETQFDMLESGEQ

SEQ ID NO: 788362 - protein, 58 aa, Homo sapiens
VDLEDSPYGKKVGEFRKETELGFEDRVGFTTFKVENVVKSWDETGVFNTHCRLEYGTI

SEQ ID NO: 788363 - protein, 69 aa, Homo sapiens
RPAPPPHRTHLSQLKAPLPEQKRRSLLTVPLLTFRAQKCGPGSPLVARGGATDSWLVSEEFRLSDSTAP

SEQ ID NO: 788364 - protein, 814 aa, Homo sapiens
MASDIPGSVTLPVAPMAATGQVRMAGAMPARGGKRRSGMDFDDEDGEGPSKFSRENHSEIERRKRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPSQTEVFQDMLPMPGDPTQGTGNYNIEDFADLGMFPPFLSSCGQSEAPAVQCHPYCDVDAHVNEAHPRPACPAAGPPPEAISPAVCPQAHHRSTLPCSRGCSATDQGPWQTLGDQLYLLYFICVCSGGEPSGSLSLVVNNLLIDNLYP

SEQ ID NO: 788365 - protein, 64 aa, Homo sapiens
MLASWLFLNQLVVLPISGPLPGCSFLEILAILSKLVFPTPPLYTPYSMYSLPFSDRLRVQRVPS

SEQ ID NO: 788366 - protein, 140 aa, Homo sapiens
LPAFGSHERNRHVKDKVVQTNCKNWAVTKTGAKNHGSSVPGHKIPSDRDLVSQGASQLTSLEINFSTSIKNACQKYQAQSMFLCDPREHLVIKQKDGTVEMRGKDKKQQPRKAHRAHRGRLIASKQKQIPIQTCKFNSKY

SEQ ID NO: 788367 - protein, 121 aa, Homo sapiens
LPLPAAERLGWDQEILGDGGGRWAEQERVGRAWESGNLKWRLKQWLGQAQWLTSVIPALWEAEAGGSPEIRSLRQAWSTWWKPVSTKNTKISWVWWHAPVIPTTWEAEAGESLEPGKQRLQ

SEQ ID NO: 788368 - protein, 102 aa, Homo sapiens
AVLELEKRIEESSETCEKKSDIVLLVGQKQALEELKLSVQQLRCTEAKFSAQKELLEQKVQENGGKEPPPVVNYEEDARSVTSMVDIEECTFAKVHSFYIYP

SEQ ID NO: 788369 - protein, 238 aa, Homo sapiens
VDVRPKTSRSRSADRKDGYVWSGKKLSWSKKSESYSDAETVNGIEKTEVSLRNQERKHSCSSIELDLDHSCGHRFLGRSLKQKLQDAVGQCFPIKNCSSRHSSGLPSKRKIHISELMLDKCPFPPRSDLAFRWHFIKRHTAPINSKSDEWVSTDLSQTELRDGQLKRRNMEENINCFSHTNVQPCVITTDNALCREGPMTGSVMNLVSNNSIEDSDMDSDDEILTLCTSSRKRNKPKW

SEQ ID NO: 788370 - protein, 112 aa, Homo sapiens
IHSSSQSKTLWFILGSSPYRITCIWFIRTCHCFAFKIDLEMHCPHLQLIALSQSPSYLLPGLLSLPPNCSPRPCHHFPHPEAPPGCPHYESWAFVHLTHACVLVPTRLLSVE

SEQ ID NO: 788371 - protein, 98 aa, Homo sapiens
GEKKAKGWELEGGEEYDDIVTFCQETSLLLSASGQGGSNHMPFQASKLLYPISHRVHGRVMYDAALPCRLDLLVSQSHSPCKKERESCFGTKLQSGEN

SEQ ID NO: 788372 - protein, 65 aa, Homo sapiens
HIAKSILSQKSKAGGITLPDFKLYYKATVTKTAWYWYQNRDIDQWNSIKKLITIVGGDVEKLEHA

SEQ ID NO: 788373 - protein, 92 aa, Homo sapiens
GLGEGLGGSGGLCSTKEQSPVPKPWAGCWGGEEKQDPSCRCPCPWAHLSRGDRHGERGELCFVSQPLSLCQTHTVVLGSRFSLLSSIKTQNG

SEQ ID NO: 788374 - protein, 432 aa, Homo sapiens
LNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWMEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKC

SEQ ID NO: 788375 - protein, 335 aa, Homo sapiens
LNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWMEAQEERLKTLQKPESVISVQKLLLDCQDIEKGLVYGMELITDPSILFLDEPTTGLDSSTAMLSFAPEKMSKRDDII

SEQ ID NO: 788376 - protein, 104 aa, Homo sapiens
SCALEQEPSRETLFPPVAAEEKAAGCRTEGGLGWAGMGAWLVFPWWPYDWLRAGQRHGRLEAQKAQDSYLGWMWGGILASLGTSLKWTGRLGGSGVCPLTKNTG

SEQ ID NO: 788377 - protein, 104 aa, Homo sapiens; identical to SEQ ID NO: 788376

SEQ ID NO: 788378 - protein, 71 aa, Homo sapiens
HNDGSTQACGESLTNPASFYFPAQRAERANSATGSWHQRSPLYPARCFFSLFVSSDILSFFSLPFPYVISP

SEQ ID NO: 788379 - protein, 73 aa, Homo sapiens
RRVASWEWQMAPRSDWLELRGVEETGQEELEMFWVSSLRLSLRFLLKFLISLLHDVLCGVCFCLLPRPPLSCF

SEQ ID NO: 788380 - protein, 101 aa, Homo sapiens
EAWRVSCIPSHTVRCVLGHQFTKFPCPDPRHQRSTSLCASQQRQLPRPQPMFPGIWALRLGDWERKPAALRAQNDPQPNLVHLPFPKSMGKLCFSWWCLLG

SEQ ID NO: 788381 - protein, 201 aa, Homo sapiens
GRSMAEPLLRKTFSRLRGREKLPRKKSDAKERGHPAQRPEPSPPEPEPQAPEGSQAGAEGPSSPEASRSPARGAYLQSLEPSSRRWVLGGAKPAEDTSLGPGVPGTGEPAGEIWYNPIPEEDPRPPAPEPPGPQPGSAESEGLAPQGKNKLPIPFPKVSTSSTSLPFRVAPASHSLLPEEHQPHTPSLQGSTSLTSPPRQM

SEQ ID NO: 788382 - protein, 134 aa, Homo sapiens
GRSMAEPLLRKTFSRLRGREKLPRKKSDAKERGPGVPGTGEPAGEIWYNPIPEEDPRPPAPEPPGPQPGSAESEGLAPQGKNKLPIPFPKVSTSSTSLPFRVAPASHSLLPEEHQPHTPSLQGSTSLTSPPRQM

SEQ ID NO: 788383 - protein, 67 aa, Homo sapiens
LDLYNICAWMMVVLYERKRLYAKCRTIHLTSGKHFQYKCSYTGCASFLHLTVSFHLLMTLEKRITIP

SEQ ID NO: 788384 - protein, 130 aa, Homo sapiens
SSITHTHTHTHTHTHTHAHIWYLHHGMLQRCNELTYLKCLWPGLGAHACSLSTLEGRWIAWAQEFETKLGNWLIFVSFVETTFRLVAQDCLQLLSSSKVPASASQSLGITGVIPTATVQQMHSYHLSCLT

SEQ ID NO: 788385 - protein, 231 aa, Homo sapiens
NNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENTLLRQQLDDAHKKANSQEKTSSTIQDQFHSAAKNLQAESEKQILSLQEKNKELMDEYNHLKERMDQC

SEQ ID NO: 788386 - protein, 106 aa, Homo sapiens
MYFLTQFFKNHANYENFTEGDNNKKTHIEHSKKRSMPWVEPQPGMDIHGCVSLHDCMWPCVWVLGGPTALRGRTHRCASLMTACGLVHKTDSLYFPGTFSHFQELL

SEQ ID NO: 788387 - protein, 69 aa, Homo sapiens
RWPNGNSFLCQNLASATQDSGCSVHRVGVCSSTCQPVKTDSIKTLPAARGAPAVTEMSCPGLLAANFER

SEQ ID NO: 788388 - protein, 141 aa, Homo sapiens
MEANMQTREVTQAFWGRGTERREKTELTAVLNKNCDYMWYSQNGLVSFQTHQVAILLAWTEDPHWRTVSAAYTDDTGHCPGLHPKESKPQTFSLRENPDFAFPVQGLMEPCVSKCQFLSNKLGRIPLTAAERGSSGLLSKW

SEQ ID NO: 788389 - protein, 81 aa, Homo sapiens
DEHGCIDYKSSYACVEWLRTSQSPQSPCLSLCEFCIYPKVSLGFLVSATFPSRLFSCNKRRDEMYKRRDEMSQDGLDLLTL

SEQ ID NO: 788390 - protein, 115 aa, Homo sapiens
ESRVVQVRPRFPGQPPEAAWGCSPNPTCSHHSVYFPLLRQDTNNKELALQAPNPPALPYPTGFWFHHFLCSQTITGQLCCLLYNVPFFNIYHCCCSQHQMFTLCLLLCTHSPPSR

SEQ ID NO: 788391 - protein, 89 aa, Homo sapiens
GYWLRSLETGASADLHARVIPKMPLDGSREELFPDLSALRAATQHYTKNSDPWYSGVFEINPVWALCRPYLTYCPRSPDEEGTMIILTL

SEQ ID NO: 788392 - protein, 180 aa, Homo sapiens
SVPGLSTCKSRVGPQGRTREGVGVPRGSAHCPRASGGPRNARQGDGAPQAPPPTPGFSFSIRHHCFVWAPDGHYGSLVPCCHGFWLGGEHVGVLGKKSNEKGKSGLTRVCTAVFKEFLRGHYTGDIKTVRIYVWPLCGRLAERQQSLQVAEEGKNSNAGERACPASFINHLGPNGSREGH

SEQ ID NO: 788393 - protein, 99 aa, Homo sapiens
MATGVPGCCLLTWDGGVWQQGRPRAPKAVKLLHLKAWGEKAGGGEERPRKPWGAPLGQCAAGSLPSLGLAQASLGLTCNLSGPRVPSNEPGALTQAHPN

SEQ ID NO: 788394 - protein, 163 aa, Homo sapiens
HLSVPHPQDCAAAEKCCINVCGLHSCVAARFPGSPAAPTTAASCEGFVCPQQGSDCDIWDGQPVCRCRDRCEKEPSFTCASDGLTYYNRCYMDAEACLRGLHLHIVPCKHVLSWPPSSPGPPETTARPTPGAAPVPPALYSSPSPQAVQVGGTASLHCDVSGR

SEQ ID NO: 788395 - protein, 109 aa, Homo sapiens
ATSVCALYWITLSSSYYFENILPLTSIFSSSCLISLQLFTAKLLKSCLHTNSTSSPPILSSTYSNFYHPHHSFLVKSLSRSPTTFMPSNPIHICSDLDLLLISQTVNTF

SEQ ID NO: 788396 - protein, 267 aa, Homo sapiens
VTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILE

SEQ ID NO: 788397 - protein, 201 aa, Homo sapiens
MINQIKFEDEPDLKDLFITVDDLNSHAYYNRNFHYVLGITYYTTSRGRICTPAELLKLQEQHIKDFSLWLGQGTNLANDSYDARHPEFYFPTQYGQKTQACISYTRETGLGNRPVIYRNLHRLQLEGNHPSSVNVAYERSLPQALYPEKTPGQKSMDNRELPNCPEHSYIFMRRTSVRSLGQQMETIVSDNRYAYESTLLS

SEQ ID NO: 788398 - protein, 52 aa, Homo sapiens
PASPSRAPISVHGSIIYPGAPARKLGVSLTVSVTTTPYFQKVLQLYPNNKAA

SEQ ID NO: 788399 - protein, 128 aa, Homo sapiens
GKEKCHQMPFKASSEISNLSDLLYIRALKHMGVPGINSISNPRKLYSSHRGFLLQMVVVPSQSGLAGWLKKCGLLTGLESAFLVWFGSLFMIESLPLPLQLCWPSLVIAHSSAVCITFLCVFAFTGWV

SEQ ID NO: 788400 - protein, 135 aa, Homo sapiens
LLGCVCVGSGGLLGCVWVGRVAGLCVWKEQTWVYNGCRTYVGEQGWTTLPPKTEGAGIPKKASLNYQLPVPAKWQKAYLETAACSEPTVSLLNAQSPWREPCHKPRSRTHCHAGFLPHHSGKQTATLKKEQGQVW

SEQ ID NO: 788401 - protein, 108 aa, Homo sapiens
PTDSYSSFLAPAASRNANNFSLGFGGGAELRRSARPTAFAAAGSPGAGGCGPQIQAEAAICTCGHSVAPGARRGTRSERDAPSHHLRIKPNNLESSCCVCHTPPVFFP

SEQ ID NO: 788402 - protein, 1135 aa, Homo sapiens
MLENYRNLVFLGIAAFKPDLIIFLEEGKESWNMKRHEMVEESPVICSHFAQDLWPEQGIEDSFQKVILRRYEKCGHENLHLKIGYTNVDECKVHKEGYNKLNQSLTTTQSKVFQRGKYANVFHKCSNSNRHKIRHTGKKHLQCKEYVRSFCMLSHLSQHKRIYTRENSYKCEEGGKAFNWSSTLTYYKSAHTGEKPYRCKECGKAFSKFSILTKHKVIHTGEKSYKCEECGKAFNQSAILTKHKIIHTGEKPNKCEECGKAFSKVSTLTTHKAIHAGEKPYKCKECGKAFSKVSTLITHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFNWSSNLMEHKKIHTGETPYKCEECGKGFSWSSTLSYHKKIHTVEKPYKCEECGKAFNQSAILIKHKRIHTGEKPYKCEECGKTFSKVSTLTTHKAIHAGEKPYKCKECGKTFIKVSTLTTHKAIHAGEKPYKCKECGKAFSKFSILTKHKVIHTGEKPYKCEECGKAFNWSSNLMEHKRIHTGEKPYKCEECGKSFSTFSVLTKHKVIHTGEKPYKCEECGKAYKWSSTLSYHKKIHTVEKPYKCEECGKAFNRSAILIKHKRIHTDEKPYKCEECGKTFSKVSTLTTHKAIHAGEKPYKCKECGKAFSKFSILTKHKVIHTGEKPYKCEECGKAYKWPSTLSYHKKIHTGEKPYKCEECGKGFSMFLILTKHEVIHTGEKPYKCEECGKAFSWLSVFSKHKKTHAGEKFYKCEACGKAYNTFSILTKHKVIHTGEKPYKCEECGKAFNWSSNLMEHKKIHTGETPYKCEECDKAFSWPSSLTEHKATHAGEKPYKCEECGKAFSWPSRLTEHKATHAGEEPYKCEECGKAFNWSSNLMEHKRIHTGEKPYKCEECGKSFSTFSILTKHKVIHTGEKPYKCEECGKAYKWSSTLSYHKKIHTVEKPYKCEECGKGFVMFSILAKHKVIHTGEKLYKCEECGKAYKWPSTLRYHKKIHTGEKPYKCEECGKAFSTFSILTKHKVIHTGEKPYKCEECGKAFSWLSVFSKHKKIHTGVPNPPTHKKIHAGEKLYK

SEQ ID NO: 788403 - protein, 606 aa, Homo sapiens
TSFVQIVQCGKAFSKFSILTKHKVIHTGEKPYKCEECGKAFNWSSNLMEHKRIHTGEKPYKCEECGKSFSTFSVLTKHKVIHTGEKPYKCEECGKAYKWSSTLSYHKKIHTVEKPYKCEECGKAFNRSAILIKHKRIHTDEKPYKCEECGKTFSKVSTLTTHKAIHAGEKPYKCKECGKAFSKFSILTKHKVIHTGEKPYKCEECGKAYKWPSTLSYHKKIHTGEKPYKCEECGKGFSMFLILTKHEVIHTGEKPYKCEECGKAFSWLSVFSKHKKTHAGEKFYKCEACGKAYNTFSILTKHKVIHTGEKPYKCEECGKAFNWSSNLMEHKKIHTGETPYKCEECDKAFSWPSSLTEHKATHAGEKPYKCEECGKAFSWPSRLTEHKATHAGEEPYKCEECGKAFNWSSNLMEHKRIHTGEKPYKCEECGKSFSTFSILTKHKVIHTGEKPYKCEECGKAYKWSSTLSYHKKIHTVEKPYKCEECGKGFVMFSILAKHKVIHTGEKLYKCEECGKAYKWPSTLRYHKKIHTGEKPYKCEECGKAFSTFSILTKHKVIHTGEKPYKCEECGKAFSWLSVFSKHKKIHTGVPNPPTHKKIHAGEKLYK

SEQ ID NO: 788404 - protein, 492 aa, Homo sapiens
MLENYRNLVFLGIAAFKPDLIIFLEEGKESWNMKRHEMVEESPVICSHFAQDLWPEQGIEDSFQKVILRRYEKCGHENLHLKIGYTNVDECKVHKEGYNKLNQSLTTTQSKVFQRGKYANVFHKCSNSNRHKIRHTGKKHLQCKEYVRSFCMLSHLSQHKRIYTRENSYKCEEGGKAFNWSSTLTYYKSAHTGEKPYRCKECGKAFSKFSILTKHKVIHTGEKSYKCEECGKAFNQSAILTKHKIIHTGEKPNKCEECGKAFSKVSTLTTHKAIHAGEKPYKCKECGKAFSKVSTLITHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFNWSSNLMEHKKIHTGETPYKCEECGKGFSMFSILTKHKVIHNGEKPYKCEECDKATHAGEKPYKCEECGKAFNWSSNLMEHKRIHTGEKP

SEQ ID NO: 788405 - protein, 123 aa, Homo sapiens
RRRGENDPGTDQSPRAAASRVQHLHPATVTATTMPKRKAEGDAKGGKAKVKDEPQRRSARLSAKPAPPKPEPKPKKTPAKKAEKVPKGKKGKADAGKEGNSPAESGDAKTDQAQKAEGAGEAK

SEQ ID NO: 788406 - protein, 198 aa, Homo sapiens
PAGPNGTGPQEETTLAMALQASKGQLPTLTPTDTFQTVETLTCLSLERNRLTDYYEPLLKNNSTAYSTRGNRIEISYENLQVTNITRKGSMLPVSCKLPNMGTSQSYLSSSMPAGCVLPVGGNFEILLHYYLLNYAKKCHQSEETMVSMIIANALLGIPKVLYKSKTGKYSFPHTYIRAVHALQTNQPLVSSQTGLES

SEQ ID NO: 788407 - protein, 232 aa, Homo sapiens
KNSGESYQAPDPGNGSIQRPYQDTVAENKDALEKTQTYLKVHSNLVIPDVELETYIPYSTPTLTPTDTFQTVETLTCLSLERNRLTDYYEPLLKNNSTAYSTRGNRIEISYENLQVTNITRKGSMLPVSCKLPNMGTSQSYLSSSMPAGCVLPVGGNFEILLHYYLLNYAKKCHQSEETMVSMIIANALLGIPKVLYKSKTGKYSFPHTYIRAVHALQTNQPLVSSQTGLES

SEQ ID NO: 788408 - protein, 116 aa, Homo sapiens
MYSGLKYLLAGACVSWKCTRSPTPKLTPLARRDLDVLFLDKGNGTPFSATGYSCWDPVAASPYWNCPPMPSQATGPGPIETLSPFLESDSLTGALAPLLPATWPGAPQSAPPDLFL

SEQ ID NO: 788409 - protein, 165 aa, Homo sapiens
IRKAWPPALPTPWRGQGHLGVFCGQMPHGSHWRGHCRSYGRFRPPDVVSTGPGSRCCRDRGGFLQVLELGARATSPAICQPLPPLCLPSCPKFCLQQSPAFGPRTALDKLHPQWPQHLSLTHCCGAAASSRNTQRTESPVALSWARLLHERPLVRLHILHPLSGR

SEQ ID NO: 788410 - protein, 167 aa, Homo sapiens
MAAPAPRPRRVPSPPARVPGERWSGVGPVCLPPAPSPNPGLLVKGRGRARARKGGGSERQRGPAERVPTVTPRSSSQGAPAPKLLARRAQSRFPDQSRGRRSQWRALSDLSPHSPPCPSEFLSVEGSGALARGKGKQFVAWDLGPLAAPSAPPAPRRPCGPVAPARR

SEQ ID NO: 788411 - protein, 499 aa, Homo sapiens
IWLGLGFRGSAVLGVCWQLRSPPSRAARMMNRTTPDQELAPASEPVWERPWSMEEIRRSSQSWSLAADAGLLQFLQEFSQQTISRTHEIKKQVDGLIRETKATDCRLHNVFNDFLMLSNTQFIENRVYDEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFTPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFFFSAPHSKPSKTRKVQSTADIFGDEEGDLFKEKAVASPEATVSQTDENKARAEQQGYLILQQKSQALIRNKRLKKAYFQMRRTLRICFLLKVRVNLKGASLLPGKLPTSVSWFDDEDEEDNLLGV

SEQ ID NO: 788412 - protein, 346 aa, Homo sapiens
IWLGLGFRGSAVLGVCWQLRSPPSRAARMMNRTTPDQELAPASEPVWERPWSMEEIRRSSQSWSLAADAGLLQFLQEFSQQTISRTHEIKKQVDGLIRETKATDCRLHNVFNDFLMLSNTQFIENRVYDEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFTPPKLTDEDFSPFGSGGGLFSGGKGLFDDEDEEVSPRHPATLPAASCVRGPQGRYRLCLFSGGKTVSQLEVASIFIFWDILN

SEQ ID NO: 788413 - protein, 295 aa, Homo sapiens
IWLGLGFRGSAVLGVCWQLRSPPSRAARMMNRTTPDQELAPASEPVWERPWSMEEIRRSSQSWSLAADAGLLQFLQEFSQQTISRTHEIKKQVDGLIRETKATDCRLHNVFNDFLMLSNTQFIENRVYDEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDVKDNFIRTPPKLDPTKELFRHFGFLEGWFNGGAGASFG

SEQ ID NO: 788414 - protein, 509 aa, Homo sapiens
IWLGLGFRGSAVLGVCWQLRSPPSRAARMMNRTTPDQELAPASEPVWERPWSMEEIRRSSQSWSLAADAGLLQFLQEFSQQTISRTHEIKKQVDGLIRETKATDCRLHNVFNDFLMLSNTQFIENRVYDEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFTPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEQQGYLILQQKSQALIRNKRLKKAYFQMRRTLRICFLLKVQSNLKGASLLPGKLPTSVSWFDDEDEEDNLLGV

SEQ ID NO: 788415 - protein, 105 aa, Homo sapiens
IVIQVFILVVKIIYFLHDIHPNIVPNGHIIFQTFWEISRQIHEFMTWTQVECPFEKDKKIQSYLLTAPIYSEEALFVASFESEGPENHMEKDSWKTLRTTLLNRA

SEQ ID NO: 788416 - protein, 84 aa, Homo sapiens
RATPGLPQLVTLSCVVVVVVVGFISLTIFYLLIGTFRTYTFNIITNTLGFTSTILFVLFISSILSFSPFLPLFDLVLFLFFPLS

SEQ ID NO: 788417 - protein, 79 aa, Homo sapiens
YTLRVLAILTPARAAAFTEVATWSPSLHRTTCCPLCASSSMPLCCPVPNNFQNDLLALIKQLSQFGNPESAPSFTYHTK

SEQ ID NO: 788418 - protein, 46 aa, Homo sapiens
YFSNTNDYNDRSYHLLRTFYVPDPKLKLHLIFFSYDFMQFKEERIM

SEQ ID NO: 788419 - protein, 155 aa, Homo sapiens
RSPRHRRICSPKGKQWCPLQPASHEPETCYKRYRGRRKREGRDREREREKERERERQLTRCPSGGAGEGSPSLPTRPGCLYTSPEGGKRSMRKGQVPRKGQGPGRRDRERQKQRERENPAQAQRGASVGIWRVEMPVAAPGLFWSMEHQSSPPPT

SEQ ID NO: 788420 - protein, 92 aa, Homo sapiens
STEDPGLLCPAYGHPGSDSPPGPGPPEALNCVLVTVSPLHGARTDLGLGWGTEIPTSSSRGEAGLPASRGHLCRAVSSLYHCSPAEGGISFP

SEQ ID NO: 788421 - protein, 81 aa, Homo sapiens
FGNCGEFSCHNSLVVVKSNYMFQMMKSTVMKSWHSSQGDRCIKPHGFSELPLTLELSTEMSMVISPRLTSSHLDLMHEARF

SEQ ID NO: 788422 - protein, 151 aa, Homo sapiens
DIISGLSCGNVFFNVGGGIWWAVFGSWGWIPQEWLGVHPTVMGSQEIWLMKSLGPRSSSLLPHSPCDMPAPSTMIGSFLRPHQKPSRCWCYAGIACRTMSQIKLFFFSRWGSHHVGQAGLKQFSHLSLPKYWDCRVSHHTQPNKTFFFNYK

SEQ ID NO: 788423 - protein, 271 aa, Homo sapiens
EKQKLLEEKEKMLEDLRREQEATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHIGEAHAIGQLSGKTFHV

SEQ ID NO: 788424 - protein, 101 aa, Homo sapiens
LPGGTSAASLSVVTTKIIQFQHGQEAECSPAAPRVPRTGLGTLQAPNIWRRQGSHPLPGRTECPSVQPLCLPPPAGHHRNHSILGQTDKRLISMAGLWRGQ

SEQ ID NO: 788425 - protein, 109 aa, Homo sapiens [sequence omitted]

SEQ ID NO: 788426 - protein, 151 aa, Homo sapiens
GKLPGGWTLAGALDTGLWSHSEELGFCPGEHGKPVEGSLPGTDMTCFRFGCDVLIQRKAPKMVSVSESTALFLPFFCFSSFLGYCIPFKILVTTGHSPLPEEKPHPDTHSILPIISGARVTQGELFWSSPSSPSCRDAHWAQSGDIFTELP

SEQ ID NO: 788427 - protein, 158 aa, Homo sapiens
GLSLSTDAQPSGQAHGRAAPSPQPRSGHPTASLPSRSLPRTGARETDKELGPSLSAGHGQAQGRKVPGRHLGTRVGARRKSWEANSQSWGWRAGRGGESGQSQPSEPPASWGSGWEACLALQRKANRPPRSARIAEAPLEKLLPLLHQTLRRASFPPG

SEQ ID NO: 788428 - protein, 566 aa, Homo sapiens
MEILRHKDIIDDLVKSGHKIMTACSEEEKQSMKKKLDKVLKNYDTICQINSERYLQLERAQSLVNQFWETYEELGPWLTETQSIISQLPAPALEYDTLRQQQEEHRQLRELIAEHKPHIDKMNKTGHSTEMSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDQLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGN

SEQ ID NO: 788429 - protein, 156 aa, Homo sapiens
GRSTRIPPGLLRSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSYTVQCLVII

SEQ ID NO: 788430 - protein, 339 aa, Homo sapiens
GRSTRIPPGLLRSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDQLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGN

SEQ ID NO: 788431 - protein, 73 aa, Homo sapiens
MIFGCKLKGSTTVTLSPASKDPDVCWPEEHLLNLLIRGKVWRKGVEVFAMNYFHYSESLVDVHLPEIKLSSTV

SEQ ID NO: 788432 - protein, 101 aa, Homo sapiens
GNTCNLRPSTVDSKQPHGGASSSPCSPGHLPGAGSERHGPQPLEGQCLLSTHLQNPGKQAISQMSLPFSVKINVKGHVWWHMPVVPATQEAKAGGSLKPRW

SEQ ID NO: 788433 - protein, 245 aa, Homo sapiens
MGRWLCFSESYQASEKDKFTEGRDRQRKMLAKRKPPAMGQDPPATSEQKQWKSRTNGAENKTLTLAEYHEQEEIFKLRLGHLKKEEAEIQAELERLERVRNLRIGELKRIHNEDNSQFKDHPMLNDRYLLLHLLDRGGFSKVYKAFELIEQRYVAVKIHQLNKNWRDEKKENYHKHACREYWIHKELDHPRIIKLYDYFSLDTDSFCTVLEYCEGNDLNFYLKRHKLMSEKEAWSIIMQTVNALK

SEQ ID NO: 788434 - protein, 94 aa, Homo sapiens
APYICNECGKSFSHWSKLTRHQRTHTGERPNACADCGKTFSQSSHLVQHRRIHTGEKPYACLECGKRFSWSSNLMQHQRIHTGEKPYTCPDCGR

SEQ ID NO: 788435 - protein, 335 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 788436 - protein, 181 aa, Homo sapiens
MLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 788437 - protein, 181 aa, Homo sapiens; identical to SEQ ID NO: 788436

SEQ ID NO: 788438 - protein, 306 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 788439 - protein, 132 aa, Homo sapiens
MILQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 788440 - protein, 290 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMELQENPCQWIVKKTSLITSSGNTGNPRTGANEACILPGRHNPIGVLIYFLTFAM

SEQ ID NO: 788441 - protein, 109 aa, Homo sapiens
QGFSLKKHLINMSTLFIFYTDLRKNEDKLNHHQRIGLKYFGDFEKRIPREEMLQMQDIVLNEVKKVDSEYIATVCGSFRRGAESSGDMDVLLTHPSFTSESTKQVPQSL

SEQ ID NO: 788442 - protein, 370 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEGSQLDSCPVKGHLNGTESLLDLIWDVMTILKLKNADLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 788443 - protein, 181 aa, Homo sapiens; identical to SEQ ID NO: 788436

SEQ ID NO: 788444 - protein, 307 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKDIFDYIQWKYREPKDRSE

SEQ ID NO: 788445 - protein, 114 aa, Homo sapiens
GLAALSAAELQGQGHSGPRHERPQPGVSVSDRRRPEPRPGRMLFPREVRKYRGGAAAAGSDPGDPVTRSFLTSSSRTGCRYLSWLASHVIVSKLSCKIRRSSESHLLNCRQHTV

SEQ ID NO: 788446 - protein, 249 aa, Homo sapiens
IVEVKVLDVQKRRVPNKHYVYIIRVTWSSGSTEAIYRRYSKFFDLQMQMLDKFPMEGGQKDPKQRIIPFLPGKILFRRSHIRDVAVKRLIPIDEYCKALIQLPPYISQCDEVLQFFETRPEDLNPPKEEHIGKKKSGGDQTSVDPMVLEQYVVVANYQKQESSEISLSVGQVVDIIEKNESGWWFVSTAEEQGWVPATCLEGQDGVQDEFSLQPEEEEKYTVIYPYTARDQDEMNLERGAVVEVIQKNL

SEQ ID NO: 788447 - protein, 186 aa, Homo sapiens
ERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLC

SEQ ID NO: 788448 - protein, 81 aa, Homo sapiens
WFPQVKWTVRVHPCPCFSLYPAASSTQPSLSYATHGREQIVESTQRDKAIQAEWVVGLWRGPPKTSGWRVRRLSPESLILM

SEQ ID NO: 788449 - protein, 68 aa, Homo sapiens
RSLNNIPLLGRESRYFHENVRGMRRVEYAAVINYPNTTWLNPTLCGSCIHTAACYAAHNEADCFHLHS

SEQ ID NO: 788450 - protein, 155 aa, Homo sapiens
LLCDGSSGPCGAVATETLAAVRRSGWGCALLEAGGSQERVGAPPLLNWQAGAPPSQAQLQPSSHDCKPGHLCTLRGPASPPAPTGSVVPGPTTWRLSTPRAHSNLGSKLRLNPGTVGTRPGLCKLKAVLTCQPPATSAPSRLWALTSTRGRLRWV

SEQ ID NO: 788451 - protein, 82 aa, Homo sapiens
LLWPGLKAPGSGRPSPSPASLLAPLRCMRGPHASWALSICIGVSPPLGGPLPSAQLRTVGLRDSERGDMRRPHCADEEHWVG

SEQ ID NO: 788452 - protein, 125 aa, Homo sapiens
HNSPPAGDNAPYPTSGDLGSDRRPHTYSPSLSDRQSWDLNTPGETPSSRPLRCTAGLPHMPESGWPQGTARRCPQIPKCGLSPSPSSLQPPSPHLCNGALPGSQVMKRGETRQCPLNTSDSTFEW

SEQ ID NO: 788453 - protein, 37 aa, Homo sapiens
MMKPQAETGEAARDPSLRPARTVLVGVSLTKSRAAVR

SEQ ID NO: 788454 - protein, 133 aa, Homo sapiens
LISVMSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHKAKSK

SEQ ID NO: 788455 - protein, 67 aa, Homo sapiens
LEGPLRSSGKGHSRRSLAPGGPPSCMGSGGAGFALISHVPAKNGDSSIKGKGEKVTGEAPQSLCHSV

SEQ ID NO: 788456 - protein, 48 aa, Homo sapiens
MSTNESVSTRTRIILSALLAFIGDDPTDLFPSMWDLKSSKGNKFVLVQ

SEQ ID NO: 788457 - protein, 115 aa, Homo sapiens
PRCNFLRSSRIRVHPTPAASTMPPKFDPNEIKVVYLRCTGGEVGATSALAPKIGPLGLSPKKVGDDIAKATGDWKGLRITVKLTIQNRQAQIEVVPSASALIIKALKEPPRHRKK

SEQ ID NO: 788458 - protein, 77 aa, Homo sapiens
MWKPIHIRHISGSRELKSSRNPSNGSRIVDPTPLTDCHREDGVCLWYRPEPPRRPKQTCNLGIQKARGRKHTHRHWL

SEQ ID NO: 788459 - protein, 283 aa, Homo sapiens
MAELQLDPAMAGLGGGGGSGVGDGGGPVRGPPSPRPAGPTPRGHGRPAAAVAQRLEPGPGPPERAGGGGAARWVRLNVGGTYFVTTRQTLGREPKSFLCRLCCQEDPELDSDKDETGAYLIDRDPTYFGPILNYLRHGKLIITKELAEEGVLEEAEFYNIASLVRLVKERIRDNENRTSQGPVKHVYRVLQCQEEELTQMVSTMSDGWKFEQLISIGSSYNYGNEDQAEFLCVVSRELNNSTNGIVIEPSEKAKILQERGSADVTLRPRKLQTFRRAVSRAPL

SEQ ID NO: 788460 - protein, 391 aa, Homo sapiens
AVSLPRNGPARLRAGSSGGGGGPRWRNCSWTRRWRGWEGAPGPGPPERAGGGGAARWVRLNVGGTYFVTTRQTLGREPKSFLCRLCCQEDPELDSDKDETGAYLIDRDPTYFGPILNYLRHGKLIITKELAEEGVLEEAEFYNIASLVRLVKERIRDNENRTSQGPVKHVYRVLQCQEEELTQMVSTMSDGWKFEQLISIGSSYNYGNEDQAEFLCVVSRELNNSTNGIVIEPSEKAKILQERGSADVTLRPRKLQTFRRAVSRALCEVKPYSCPVTEPLKAQLILAPCEEVFWCKTKGTPSPPAGLRRQCDFWLQNTFSETCFHLLSQYVEQIFTTAAGLGSQSEPFGDLGDEGGRPSSLEMACTLRTLEPRGLFPCRAMVSPYVCHNGR

SEQ ID NO: 788461 - protein, 202 aa, Homo sapiens
APPLCELPGSARSSPDRYSMEAVDMNTEDGFAFEEESDFNGNAHPSDTSELFEVKAQASRMQRLLGPSETSSLRNSQSENSSLNNMPLRGGLSVHTCSSASQSEASSMVNFPAYSVRSESSSAFQFSDIIDQLEQLSYPPTTAEDSSSTESDSWDSETEAPLDISLFFSNPFAHTSGERVPFDLQNNLKNLTPGEQIDKNPS

SEQ ID NO: 788462 - protein, 68 aa, Homo sapiens
RVVCGLALPWLNREAKVGSQPLGEQLCRPWRQLLVLRARAAGGAALCPSSLAAPSRGSRPLEAALLPG

SEQ ID NO: 788463 - protein, 101 aa, Homo sapiens
SRQASPRAHPEQPAAAWKGLALAPRCRGALPACLLLGLPGLPPTDHENSSSMGRESDQSDNSHPLTAQHCSLLPRYSYQTRSALLLLGGQKRPPNPVQDSR

SEQ ID NO: 788464 - protein, 35 aa, Homo sapiens
MCLRDLSRDLLLRKSEVHSKVRSVTSPEAQLIQVL

SEQ ID NO: 788465 - protein, 115 aa, Homo sapiens
MKYHVSIVPSVHSLACLYVTISDSAVWWSLHTDAHEIWCLDSEQGTSLGRSIPHPPALCSVRKIHLRPQVLRPTSPRNISPISNPVSGLILLSSPTSLTVPQPLSPFHSSISPFS

SEQ ID NO: 788466 - protein, 102 aa, Homo sapiens
KDSRGVRLKKETSQQILAIKCALNSISEIWPKCCGHPSRKPVIISGLPKTENYEDADEVVKLWKRTITKQYVHGQVQWRAPVVPTTWEAELYSNASQTFSNT

SEQ ID NO: 788467 - protein, 152 aa, Homo sapiens [sequence omitted]

SEQ ID NO: 788468 - protein, 40 aa, Homo sapiens
MEETENKFQILNLPHVFEGSQGFPDFTFKILTLRAGHGGS

SEQ ID NO: 788469 - protein, 182 aa, Homo sapiens
ALEDPRSLGKSVLITAVLLLLSLPVLAAGITILLTDRNLNTTFFDPCHNPIPNAPLRLIRPNHSSPTSPISPSPSCWHHYTTNRPQPQHHLLRPRRRRRPHSIATTILIFRSPEVIFLSNRVRNNLAYCNYYSGTKTTGYKGRAGARQPGAHRDNERAHHTSPQESTTTTSSPGTEKQQRAK

SEQ ID NO: 788470 - protein, 85 aa, Homo sapiens
LCTRDAGLGHVAPWKLEDAPGLTLQGVRALGMEGRGTRQEGEPQGGESPGRAGCGGFAQPPWALHGSARTLLRTHSRPAPYRGVE

SEQ ID NO: 788471 - protein, 85 aa, Homo sapiens; identical to SEQ ID NO: 788470

SEQ ID NO: 788472 - protein, 105 aa, Homo sapiens [sequence omitted]

SEQ ID NO: 788473 - protein, 107 aa, Homo sapiens
SWPASAAGSPGSRSRLSLHTSLQAEGVGSGLGQPRKGLPQCSGGLKGSSSATKVGAQAEEAVRASQGCEDCQHAVTSHYDFIPSLLHRCLEIEVRHPKSENLKSSKI

SEQ ID NO: 788474 - protein, 114 aa, Homo sapiens
NIQWICLHNRLDCQNGDEIVQQNLCLQQNFIPCCINNSQVSQGRNWWEVTGSWRRFSPCSSCDSEGVLMRADGFKCGISSLFLTHSCLLSCKTCLCFSSAFCHDCVLRPPQSLG

SEQ ID NO: 788475 - protein, 251 aa, Homo sapiens
LLLSPAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRARPRCGPRCVGGRGGGHMWCCWYMAGGSWPYPAEVTKEEEQPWGQKKTQWPRGI

SEQ ID NO: 788476 - protein, 108 aa, Homo sapiens
GGARGEGAGRVLFSPPWPCWPWQKGPAQCCWPGNLAKDRRPSSEAGWPFGEQWLRCPPRHSDRHLQSLFSALPKASSVSRDTVLGYRDRAPCGIVLSGVCASHPVWDC

SEQ ID NO: 788477 - protein, 309 aa, Homo sapiens
MEQLLGIKLGCLFALLALTLGCGLTPICFKWFQIDAARGHHRRVLRLLGCISAGVFLGAGFMHMTAEALEEIESQIQKFMVQNRSASERNSSGDADSAHMEYPYGELIISLGFFLVFFLESLALQCCPGAAGGSTVQDEEWGGAHIFELHSHGHLPSPSKGPLRALVLLLSLSFHSVFEGLAVGLQPTVAATVQLCLAVLAHKGLVVFGVGMRLVHLGTSSRWAVFSILLLALMSPLGLAVGLAVTGGDSEGGRGLAQAVLEGVAAGTFLYVTFLEILPRELASPEAPLAKWSCVAAGFAFMAFIALWA

SEQ ID NO: 788478 - protein, 106 aa, Homo sapiens
GVVPALPSRCPGASEVCWRLRPGPARGALSAELATLSPTSLCRGRGPGLLQLPWIRWKDVENGGSSISPSTHPHLLGHPPPPKSIIASGPLDLLFHSLPDMECPRL

SEQ ID NO: 788479 - protein, 86 aa, Homo sapiens
AGSTHTPRVQGSAAQGGRHTQNAHNAGKRDLGSQDADGTKPRPPLSPKCGFQMVIQGSSWFRALFTGLPGQLQGRGVVPVGERPWE

SEQ ID NO: 788480 - protein, 134 aa, Homo sapiens
ISLLGIYPEVLRVGLNRYFHIHIHNSQKVETTQFSIHRCKDFFKMCFVYTMGYYSALKEKGAGARWLMPVIPTLWEAKAGGSQGQEIETILANTVKPCLKIQKISRAWWRVLVEPATWEAEAGDWHEPGRRSLQ

SEQ ID NO: 788481 - protein, 117 aa, Homo sapiens
QYLPLLPIILFWISNMLSLLFLCTLHPSLSLPSLRLTLTPIRLSKLPGLYCRKASQTAPITSIKPKFHPHLLVILLFTILNYSYMPCSCLHCRFTLFLQAITADISWCYPQTATLNS

SEQ ID NO: 788482 - protein, 110 aa, Homo sapiens [sequence omitted]

SEQ ID NO: 788483 - protein, 135 aa, Homo sapiens
MIPSDIEPDGSYSQDISEGRQLLIKAVNRVWTELIHSKKQVLEELFKVTLPVNERGHVDIATARPLIEEAALKCWQNHLAHEKKCISRGEALAPTTQSKLSRVSSGFGLSKLTGSRRNRKESGLNKHSLSTQVLF

SEQ ID NO: 788484 - protein, 109 aa, Homo sapiens
KKLKANQTPIAMDCCASRSCSVPTGPATTICSSDKSCRCGVCLPSTCPHTVWLLEPICCDNCPPPCHIPQPCVPTCFLLNSCQPTPGLETLNLTTFTQPCCEPCLPRGC

SEQ ID NO: 788485 - protein, 148 aa, Homo sapiens
PASTSQSVGIIGVSTAPSRLCSFKRSSSFLPFITCPPWPFMAPLLPWTKQRCDWCSQHLSTDTIFLSGPEVLDYRAGLPATCHENLTRTSGTLLNLLTPPLRPALDNSYILEKGNETGLKPLPTVQKAQAPFPRQKEPDSSAHVPLFI

SEQ ID NO: 788486 - protein, 70 aa, Homo sapiens
QQPRVHSVCLCVYVCVHFLQFCHMYSLASLSLQSESSAVPSPTIPVFAFIATSILFSSLALATTHIVQLS

SEQ ID NO: 788487 - protein, 540 aa, Homo sapiens
MTTSLQDGQSAASRAAARDSPLAAQVCGAAQGRGDAHDLAPAPWLHARALLPLPDGTRGCAADRRKKKDLDVPEMPSIPNPFPELCCSPITSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 788488 - protein, 225 aa, Homo sapiens [sequence omitted]

SEQ ID NO: 788489 - protein, 67 aa, Homo sapiens
TLHYAGLIIVVKRTHLEDNVEDDGEMFHTLDDGHTRFTDLIQLVEFYQLNKGVLPCKLKHYCARIAL

SEQ ID NO: 788490 - protein, 66 aa, Homo sapiens
TCQDLPATNSPPITVSHTVEDDGEMFHTLDDGHTRFTDLIQLVEFYQLNKGVLPCKLKHYCARIAL

SEQ ID NO: 788491 - protein, 453 aa, Homo sapiens
MSLSARRVTLPAITPIILQKRVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 788492 - protein, 439 aa, Homo sapiens
MELRKGFVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 788493 - protein, 453 aa, Homo sapiens; identical to SEQ ID NO: 788491

SEQ ID NO: 788494 - protein, 488 aa, Homo sapiens
MTTSLQDGQSAASRAAARDSPLAAQVCGAAQGRGDAHDLAPAPWLHARALLPLPDGTRGCAADRRKKKDLDVPEMPSIPNPFPELMLFSNYICVVSRPISQSKFKEKTERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 788495 - protein, 374 aa, Homo sapiens
MSLSARRVTLPAITPIILQKRVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDG

SEQ ID NO: 788496 - protein, 303 aa, Homo sapiens
MRWPQPQSQPNTATLNGAQRARTGHDNCATRGRCIPLSPRLTDYFYYGYLTLHEVTLYTRLAHATLTHTSRTASYAPYLSILLAHLAVAHAATTSPTQTQHLQPHACYLNGLPASTPTKHSGTHLPDIIIQKITLHSNMGALHVEADNLAALKFNSSQKNEAIARVPSYPVTPTTAIAPFVHHGSAPLKTFQSTHTNAFHNNYWRIPPPESGVRPTSYTQQHATSHFLKRALSIPDISRPPLVHTSPLATTSSDPRQYALRQPILPTIDSQCALDMLAEHPMIDVDSPSTRVSLHNVNIEFAR

SEQ ID NO: 788497 - protein, 33 aa, Homo sapiens
YKINIPRNVGKKRKMKYYCILVDILELLQDFVR

SEQ ID NO: 788498 - protein, 84 aa, Homo sapiens
VSHSYFRLFLFVFYAVCLCSNTVDMFTDIAAGPLTAWGRRWAPWWVGLEGGLGVSEDADGEDASVRESPQGRDQHLGQSLENFL

SEQ ID NO: 788499 - protein, 84 aa, Homo sapiens
SPSTQRISLHHVFQLEVASAILDCFFYLFSASFSDVKLKPETMGVHQIFGSYEGTWMELETLMLSKLMQEQKTKNHIFSLISGS

SEQ ID NO: 788500 - protein, 67 aa, Homo sapiens
HRNRKHIIHKRLSPIYYSHRYLPDKRLQHSNNSSHPNRDLSVGMMWQTGLETLGKWARLRYSHRDRH

SEQ ID NO: 788501 - protein, 67 aa, Homo sapiens; identical to SEQ ID NO: 788500

SEQ ID NO: 788502 - protein, 394 aa, Homo sapiens
MIGRNLREDGGKAAKEVKLLLLGAGESGKSTIVKQMEIIHEDGYSEDECKQNKEVVYSKAKQSIIAIKRAMGRLEIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGTNTYEEAAAYIQCQFEDLNRRKDTKEIYTHFTWCHRHEACGQNAKKTAWYKKNSPLNKTNVTKGNRWRLHTCSSTGRLGKSDHKKSTETKTQTHDRVGRRRAQTRPNAGPGNAEAGRNN

SEQ ID NO: 788503 - protein, 255 aa, Homo sapiens
QEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEVLMS

SEQ ID NO: 788504 - protein, 162 aa, Homo sapiens
MALARPRPRLGDLIEISRFGYAHWAIYVGDGYVVHLAPASEIAGAGAASVLSALTNKAIVKKELLSVVAGGDNYRVNNKHDDRYTPLPSNKIVKRAEELVGQELPYSLTSDNCEHFVNHLRYGVSRSDQVTGAVTTVGVAAGLLAAASLVGILLARSKRERQ

SEQ ID NO: 788505 - protein, 129 aa, Homo sapiens [sequence omitted]

SEQ ID NO: 788506 - protein, 128 aa, Homo sapiens
DIKEKLYYVTLDFEQEMATAASSSSLEKSYELSDGQVITIGNELSCCPEALFQPSFLSMESCDIHKTTFNSIMKCDMDIRKDLYTNTVLFGGNNMYPGIANRVQKIVTLVWMGSSILALLSTFQQMWV

SEQ ID NO: 788507 - protein, 66 aa, Homo sapiens
IPSHDLKARLNLPKCWREPPALPFQPYRCRQFLTLPSQAVSTALTTYLNIFDNSLYNSLIKVLLFE

SEQ ID NO: 788508 - protein, 70 aa, Homo sapiens
PIRPIERGMTHAYWALSDNEGTCQTQDVQGNKKRKSDITPITIKDFPEGSDIDKLGGKLSLEMKGTVHKS

SEQ ID NO: 788509 - protein, 111 aa, Homo sapiens
KGTVPGCARRLNLCFSLPKHVIVAKSNRAAALDLCFSLPKHLSVGKSNRAVLLPAFLLPGSFLLSQNRTKGNGWLYNETFHSQRRAGDRRLPLISTAKRPPSLRLLSTDPL

SEQ ID NO: 788510 - protein, 137 aa, Homo sapiens
LVFSPTLPDKLLPQGLCTSCLFLLLGELFPQISALTHSLTSFKFPLKSHHLNEANSDNSRNLASPPSPLSPSFSALFFPFSTAPIISRNTYICLLIAFTVCLPLREVKIFVLFSDVYQMPRIMLAFGRHSINTFLYV

SEQ ID NO: 788511 - protein, 137 aa, Homo sapiens; identical to SEQ ID NO: 788510

SEQ ID NO: 788512 - protein, 43 aa, Homo sapiens
MLDHLWVSITSASSLFLTKLHLFLRMTHHRENSKLDENLGGYR

SEQ ID NO: 788513 - protein, 267 aa, Homo sapiens
PRSRKPSKAGTAPSPRVDAGLSLKLAEVKAVVAERGWRHSLWVPSGEGSAALAPHRTSEHKSSLVPLDAREHEWIVKLASGSWIQVWTLFWEDPQLALHKDFLTGYTALHWIAKHGDLRALQDLVSGAKKAGIVLDVNVRSSCGYTPLHLAAIHGHQGVIKLLVQRLASRVNVRDSSGKKPWQYLTSNTSGEIWQLLGAPRGKPIFPVYPLVGSSSPTRKAKSKEISRSVTRKTSFAALLKSQHNKWKLANQYEKFHSPREREEYSD

SEQ ID NO: 788514 - protein, 76 aa, Homo sapiens
MKFRENPAAGMRRKTEHLIIRKENGKRLLSLVGKPRLCSRLLFQRDFYNRGAAEATLPSATAHEPSSRLSSTLKCF

SEQ ID NO: 788515 - protein, 85 aa, Homo sapiens
NPASRLLIPRKTLNQWDHVLQMVTEKITLRSGAVHRLYTLEGKLVESGAELENGQFYVAVGRDKFKKLPYSELLFDKSTMRRPFG

SEQ ID NO: 788516 - protein, 104 aa, Homo sapiens
MLSLLLLCTLHPSLSLPSLRLTLTPIRLNKLPGLHCHKASQTAPITSVKPKFHPHLLVILPFTVLNYSYMPCSSLHCRFTLFLQDITADISWCYPQTGHSKLLK

SEQ ID NO: 788517 - protein, 77 aa, Homo sapiens
NIDGAPPRCQALLQPLGNQPWKHTDPALPAPVFWWSGGEENQQEPAQESDGGSAERNKLGGEGELQRLHGCDGWSGS

SEQ ID NO: 788518 - protein, 44 aa, Homo sapiens
IFSLSLNKVVGIGPKGFIKATHRGPRNTSMVSGMWFFEDLAEYR

SEQ ID NO: 788519 - protein, 125 aa, Homo sapiens
KSCQPVTTDTQCRHLQSIGKRLAFCQNLTQIHTESTMKPWILLLVMFISGVVMLLPVLGSFWNKDPFLDMIRETEQCWVQPPYKYCEKRCTKIMTCVRPNHTCCWTYCGNICLDNEEPLKSMLNP

SEQ ID NO: 788520 - protein, 105 aa, Homo sapiens
NPPTLTSQSAGIMPLSHHAQLFTSPSKMRLQDSRCGGCCKGSSLCHTAIAMVKLSKEAKQRLQQLFNGGQFAIHLGFIPLVIYLGFKRGADPGMSEPTVLSLLWG

SEQ ID NO: 788521 - protein, 325 aa, Homo sapiens
QLAQQLLHYHAIQASTQEEALAGWEPMGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPT

SEQ ID NO: 788522 - protein, 113 aa, Homo sapiens
MAEQEQLRPVAPSEIDIEGLGHQDAQHRTEAPLVLHLVTWNCCAGPHRHSLQPSLAPTHHSSVGCPFAEGLPSDTPPRLLVLQPCCGQFAMRRLQWPRLLETVRCSWERKDTL

SEQ ID NO: 788523 - protein, 34 aa, Homo sapiens
MVRGAGPGPSLSALSHPTGASGMAAAEGPGYLVS

SEQ ID NO: 788524 - protein, 33 aa, Homo sapiens
MSQSLGGLQSMKENTSVLSQAEVICILINKLTE

SEQ ID NO: 788525 - protein, 83 aa, Homo sapiens
LYILEQAMTSQKDFSKVSPATEDSVDWTGRVGGQVEKALVCKWGAALGAQPVPCALTSGMAWMDGSTSGPPGWTGTGCSSPWR

SEQ ID NO: 788526 - protein, 121 aa, Homo sapiens
QHCCKHVSPPTIGRFLSYLRIEQMYNRVLYRDIQFPGAGRRQWPSSISTARGFPLLLIHLSTDLLWVSGWGTVRSFSSHKAIFQTITWGETLDNTPLSRAEVPAAFRNALCPWFIETREWR

SEQ ID NO: 788527 - protein, 129 aa, Homo sapiens
RPEVTGPFFMDSGHIWSIFVSWPLGRMWARPPGAVAWGDQRSPEGLAERPRGIHTPIPVAELIPRSALCFLVNQMFTALLLSLLQAAGWGRRVPVCSSLQREASSPPQGQPGWQATASRRQCACHGTRG

SEQ ID NO: 788528 - protein, 117 aa, Homo sapiens
DVSAKAVDILSSRHQCLYVISHPESRRSEEDQPVPTSCNLVFKVFPTQPLDPSSLSLIYQLALNSFFTCLSPHQTESSMRAEASHLCIPVYTQVSWQSICCTELKNKNLAWCGGSRP

SEQ ID NO: 788529 - protein, 59 aa, Homo sapiens
LGKRAMWKVNVCQMLSANSQLYKWRQQDQKRSQPELQNPCRAKISSTGLHHWNKHKVLN

SEQ ID NO: 788530 - protein, 45 aa, Homo sapiens
LELINEFSRVSGYKINVHKSVALLYTNSSNQGENQIKNSLLFTIV

SEQ ID NO: 788531 - protein, 124 aa, Homo sapiens
EEPQAVDVSGGTLVEQRPEELLRPSGICRLPTFGRLLVANVLQVMAPESNWAQIAVSSNAVEPGPTPTFTSWISELQDGSAHRTLSWPRLGLASVDSMFWASLLLSAGACACAGRPLIDIKATG

SEQ ID NO: 788532 - protein, 265 aa, Homo sapiens
APSRPRAPAQAMMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQ

SEQ ID NO: 788533 - protein, 102 aa, Homo sapiens
RLWLPPGPRTPASSGQTERGDTLHPVAGKRGLGLCPSGTEQSHHPMQALSPQAKLGLGKAACPGGLRDWGTMWELGWKPSCFPPSQTPVWAPGARGEGRSHG

SEQ ID NO: 788534 - protein, 105 aa, Homo sapiens
PQRAKVWNQKDCGLNPKYYCILPLWPYASSLTSLRGKCLISNMKIVILTPLCYKFNTGTVLQHSIHGCSFCLCFVVIVSNIRYKAGQEDLKLHTYLCQAEQTVWV

SEQ ID NO: 788535 - protein, 70 aa, Homo sapiens
RSPPDAQVKTDLEILKYAVLLEKCGATGTTSSFRQEPMRPSKPSTEASVSSLWWLQTPRCKRAFCTPTAV

SEQ ID NO: 788536 - protein, 74 aa, Homo sapiens
ILSTSTASVTTYVLTTLKSSSLAQFSLRDSLLYIPSPAEHLPSDVPLVGQTQQSKLTSSSLVFPVSVRSIITSQ

SEQ ID NO: 788537 - protein, 43 aa, Homo sapiens
MLSSGSSLATLPEIAAADTCKQEAPPAGAGSAHFSGPAGPPAA

SEQ ID NO: 788538 - protein, 118 aa, Homo sapiens
MIVLATGDNWDGFRTIMVKERVMGVMTSAVILMTTSMTGLREHLGKLGRLLNSNCWVDLGTLAEGGQVMGHVSVSLSHSGPSSKPHVCDLCFFSIPFSGNHLSTPGKSLRFPFHFPGL

SEQ ID NO: 788539 - protein, 110 aa, Homo sapiens
MILNTSTPLRPIFPCSTLEGKPPPKKHTELATPKHWKGAIVFRSPRKGHRWRHPPAPAPPPSAPRPQLLSSSAHLEQSFPRPSDPDPSSPGPAAGREEPRPRGYLARASC

SEQ ID NO: 788540 - protein, 45 aa, Homo sapiens
MHERLQNISNNQTSSLCDHGGRRWRQGHAVILSGQRGKDALQPQK

SEQ ID NO: 788541 - protein, 48 aa, Homo sapiens
SACACMCMWVQLYACLCACMSHIVCVSVCVHACSALCLCACKSHIVCV

SEQ ID NO: 788542 - protein, 107 aa, Homo sapiens
LLPSLRGQFSLEEKSLSLKIMQYLCPACSESEQAGNPHVTLFYSSQSRQPCRIWPYHLCDISSPTPPSPLHCRHTGILTLLHPHQAHSSLRAFVLIICPTDVHLTPP

SEQ ID NO: 788543 - protein, 78 aa, Homo sapiens
VENREFVGNNKVCAQPLKKMCQSLSKPQEPVSCECHHLGLPCWPVSSGFGHWEATTGGLDLVTGKQQQGKASGFLFPG

SEQ ID NO: 788544 - protein, 84 aa, Homo sapiens
EPAPNYSSRSARRSERASVPSVPSEPGAGRTVVCHAQPLVRDQARVGEGSGRAGLGLGLPEGVLARISFFHTLTLRPALGIVVY

SEQ ID NO: 788545 - protein, 77 aa, Homo sapiens
KAANRTPPKSPGDPSKDRAAKRLSLESEGAGEGAAASPELSALEEAFRRFAVHGDARATGREMHGKNWSKLCKDCQV

SEQ ID NO: 788546 - protein, 84 aa, Homo sapiens
RGRDEKGAGAVGGTPGGGNYQGCEGLTWDGILPPGLRKKILRWRPADWAGRWRARSRPPDRLPPVFPDAWAPAPALSPFPPNWH

SEQ ID NO: 788547 - protein, 126 aa, Homo sapiens
RPSAMIINKALYDICLRTLKLPTPTYSDLNHLVSAAMSGVTICLHFPGQLNADLQKLAANMVLFPHLHFMYGFPLLTSWDNQQYWALMVREPTWQFFDAKNMMAACNLCHGCYVMVAAMFRGHMSM

SEQ ID NO: 788548 - protein, 73 aa, Homo sapiens
MEGEEEDFQGWRIVLFLKDEQFIKGWGKASWQSPRCPPKVSVTAQQPATFNAASSPASLPGEAHVGMKPPLEE

SEQ ID NO: 788549 - protein, 71 aa, Homo sapiens
RGSSLTNPGVDKTDSGHHATRRAYQDAETADGVRGKQCGIPASGLPVRCSGGEETNVKGDGYISSRLFSEK

SEQ ID NO: 788550 - protein, 92 aa, Homo sapiens
RGRRKRRRWQCLPWDGLPCTRAFVSKSQGTVSSSACRREEPEPRVRATRGNLGRVDFSRNIFCQRPWRKSYCWRLLVSSDDNIPNSARSVQS

SEQ ID NO: 788551 - protein, 114 aa, Homo sapiens
SGCAHSDPALSKPFSYPPLARSSVHGGPPSPHLTRQLPAMLRPLCPALWMASLWNAIRLMKEGGLRGNRKERCAAQAPLASSRLRACSMAISNKRPPHCPTGPQHCMKLQVHPS

SEQ ID NO: 788552 - protein, 81 aa, Homo sapiens
MMLATGVGPITGDRGGTKANHDADSRRKQICMHKDHSVSLMEEASVREVGTGGHLGPHITPLHHSDCSGLGRVVAVELKSR

SEQ ID NO: 788553 - protein, 179 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRIWNLEGVQTAHFVLHSPGMSVCWHPEETF

SEQ ID NO: 788554 - protein, 79 aa, Homo sapiens
MAHKQIYYSDKYFDEHYEYRHVMLPRELSKQVPKTHLMSEEEWRRLGVQQSLGWVHYMIHEPEPHILLFRRPLPKDQQK

SEQ ID NO: 788555 - protein, 79 aa, Homo sapiens; identical to SEQ ID NO: 788554

SEQ ID NO: 788556 - protein, 79 aa, Homo sapiens; identical to SEQ ID NO: 788554

SEQ ID NO: 788557 - protein, 120 aa, Homo sapiens
MAHKQIYYSDKYFDEHYEYRMLCYPGEPIKRLPKTHLMSEEEWRRLGVQQSLGWVHYMIQRHVMLPRELSKQVPKTHLMSEEEWRRLGVQQSLGWVHYMIHEPEPHILLFRRPLPKDQQK

SEQ ID NO: 788558 - protein, 79 aa, Homo sapiens; identical to SEQ ID NO: 788554

SEQ ID NO: 788559 - protein, 131 aa, Homo sapiens
MWYLPFCDQLLSRSLMPPRFIDVRIGLCRNISRIISVLCKGRVLCIHSSTHRHLRCFCFLASVNNALRNAGISPTTFGLTSLISSKQAILEAYRGVGPLTSLGRVGGSLTSLGPSCWLGRRGPQVPASTQH

SEQ ID NO: 788560 - protein, 189 aa, Homo sapiens
MAQKRFPILHLWIGSAVSSRDEHGACAVLAVHLKTLLGERACAAPGWCRANESDLFMSYFPRGLKYQEGGVESAFHKTSTGAPAAIKKLYQVKGKKNIRATERALNWDSFNTGDLFILELGPEHLRLVWWKVPTILERNKAEDLALASRTVSDRARPVEIVTDGEALWKITGWAQPVLRGHRETPERKP

SEQ ID NO: 788561 - protein, 233 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGLAASQRQSHGTRGFLLGSVHGLCGRPPVNGVLEFSHRAHVPRRPPSCCLRLSGEEGGQGKAVCGDSLGENSTGEGTQRHTSLGRQS

SEQ ID NO: 788562 - protein, 105 aa, Homo sapiens
MRVLWVLWHQLISRGQNYVMPLEFTIVCESPVYLGLRLDYLHDPMFLPLSSAHPLHRCLLWLLHLAGMSPPACSHSSLLSSTDFLTIAGNVHTFTKVLGCLRGHY

SEQ ID NO: 788563 - protein, 112 aa, Homo sapiens
LHPGFAQGILPIFGHLENAYAAGLLPRAALDVRLPEPRFSNIGSHACLAGVYCPLPRPGCEHRTPSPQPMGSMCPVLRAYQCRTSRHAVSCQLRTWGGGRPGIWRSLSFQSS

SEQ ID NO: 788564 - protein, 70 aa, Homo sapiens
GHSSVSQNRNSAPIAHNSASLPQFHRNDPFVTQQLIYSDKVSSPSFSQIKSNASHTNGQELQLTEESPYL

SEQ ID NO: 788565 - protein, 144 aa, Homo sapiens
VAPRSKRRCVLERKQPYSGDEWCSGPDSEEDDKPIGATHSECLSMPGCCEPVMFLGDGLERTEPGKEVRTGSPGFFSPILPLRLCPSLHCNCLASAFQVLSDPLSLGTLGGAEWSGLLLGHVTCTSTCEFLAYAATYWLVEGGR

SEQ ID NO: 788566 - protein, 39 aa, Homo sapiens
MALKNSQLTFQPNVHVPKTTSASQSISQKSAFAKVSNPQ

SEQ ID NO: 788567 - protein, 88 aa, Homo sapiens
KTSFRARERNIPDGILCEGSESRRATGVTDQACSPALCTHLVLAHHESRHRPAVMITLLLNSTLAEEPPHFITTPPSSGPGETFPPAA

SEQ ID NO: 788568 - protein, 101 aa, Homo sapiens
RSGRLEVGGWQNIREAFLKRPLSCEAQNEIGYSRQRGRDVCTSVMFCSQGLGGGPSSPSPDRPRDFTLFWWLMANQARSPEFFALTQCFSNFNVLMNCLPV

SEQ ID NO: 788569 - protein, 33 aa, Homo sapiens
GRVQFGIAKAAPEGGRAGRGRHILVRNPAGGRG

SEQ ID NO: 788570 - protein, 348 aa, Homo sapiens
MGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 788571 - protein, 348 aa, Homo sapiens; identical to SEQ ID NO: 788570

SEQ ID NO: 788572 - protein, 351 aa, Homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 788573 - protein, 373 aa, Homo sapiens
ARYPPGVAYLFLMFHTGLLCPQMVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 788574 - protein, 116 aa, Homo sapiens
GDHSNPKLRAVGAGPLTACPAHFRLCPTGAFVVCWTPGQVVLLLDGLGCESCNVLAVEKYFLLLAEANSLVNAAVYSCRDAEMRRTFRRLLCCACLRQSTRESVHYTSSAQGGAST

SEQ ID NO: 788575 - protein, 333 aa, Homo sapiens
MGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDVRVLRWGEIRALSGHATRYDWVMRTDCGHPIYLSLIL

SEQ ID NO: 788576 - protein, 98 aa, Homo sapiens
MTHSVQMNSMGSVLGMAISPSRMPQPPNMMGAHTNNMMAQAPAQSQFLPQNQFTVIQRGDECGHGAAASTRKDSNPAEQQQPYSFPAYHSSPCCFSSL

SEQ ID NO: 788577 - protein, 113 aa, Homo sapiens
MFLSSGERRAPFTWEFLSPVFRERRKIRVPSLHLLFSSCLSLSLLIRISHMSLSQLQWSLEYAIFPSIWERKVNMEHCLGCGGQQTLGQNLIVGAPVGGECYDPMASLVIYSS

SEQ ID NO: 788578 - protein, 102 aa, Homo sapiens
SGSPPWRRKPGDLTPTLLCFSQEVTHLILTYSLLIRISHMSLSQLQWSLEYAIFPSIWERKVNMEHCLGCGGQQTLGQNLIVGAPVGGECYDPMASLVIYSS

SEQ ID NO: 788579 - protein, 54 aa, Homo sapiens
MVKPSSWVSEERGLVPALRVDVGALPSHRLFLGQRRTDLRQAGVGQVTATDKVA

SEQ ID NO: 788580 - protein, 131 aa, Homo sapiens
LQLKPREAKCRMSKFQAVGTACASSEVATGWHMERRAEGLVQQEGGRRENRSLEGEGGDGPQRLLAGRDADSAQGQQSTPRNTQALHAGAGFSFFLTQSLALLPRLECNGQILAHCSLRLLGSSDSPASAS

SEQ ID NO: 788581 - protein, 104 aa, Homo sapiens
MRSPTHSDLVKPDWDSGPEGKDHPCIANIWMGRKLLSLIDFFRLSLSDQNIVKDMKLTLETQNYFHSLGKSCHQIPITFWREWKHDRILGFKELKIRPGSMAHA

SEQ ID NO: 788582 - protein, 149 aa, Homo sapiens
INGPWLRPSDSPPSVSKHQTHNHRHRPQHSCLLQESCRFGETGWVPEGLREETAGLSPGGLEGITGPIFGVGLTEPQGHLAGRCHPLVQDRGGDGGSGVGGEFIPGLRLRTPTFQGFLSPLSCPGQDLCSLTVPTGSKRLVRAIVLASA

SEQ ID NO: 788583 - protein, 176 aa, Homo sapiens
GGLPRPPGYQPIPFSQSGNPVMSTVAFLASVVDPRVASAAAKSALEEFSKMKEEVPTALVEAHVRKVEEAAKVTGKADPAFGSGKQGMQEPPLMSLSDEESGNDEARVEGQATDEKKEPKEPREGGGAIEEEAKEKTSEAPKKDEEKGKEGDSEKESEKSDGDPIVDPKEDEGAMY

SEQ ID NO: 788584 - protein, 203 aa, Homo sapiens
GGLPRPPGYQPIPFSQSGNPVMSTVAFLASVVDPRVASAAAKSALEEFSKMKEEVPTALVEAHVRKVEEAAKVTGKADPAFGSGKQGMQEPPLMSLSDEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEG

SEQ ID NO: 788585 - protein, 155 aa, Homo sapiens
QYGDPPIYVMENGASQKFHCTQLCDEWRIQYLKGYINEMLKGGKLVPQSFGNLLYQQSDACCRALAKSHANGYGDRGTHCLLPLCPHHWCSTNAPPEEAELTQDYQFWSFIRESSGSSSLFCFEGFHTLLFSGSTIITFFSLSLFGLRWDLRIRK

SEQ ID NO: 788586 - protein, 114 aa, Homo sapiens
MILQAANTALTCTQSASPAPIQPASPAPNQNHLHPISQQHLHPASITCTQSISITCTQSASITSTWKLPQLPFSTKPNNRPPLLLWHPLHATNQCLHCPELPPNTHPVHELTVL

SEQ ID NO: 788587 - protein, 118 aa, Homo sapiens
MGPQSSALHAQCPGLKAHVCRAQGKGALRTKLGPGEPAPVLGVAHCFLSRNAQDNQLLAIFPAQAPQPESHHHHTVDPGQASGLFWASPSPPGSAGANAHLWAVSHHRPRASSVPGTQ

SEQ ID NO: 788588 - protein, 83 aa, Homo sapiens
PSREPTRRSASLEPPGCSNPGRRPGRFRGLLKQARGRAGEGHSAVLLAPESPNAQVSNVTSAIHRSNRSGFPRPCSVILPDKP

SEQ ID NO: 788589 - protein, 109 aa, Homo sapiens
GWAAARARPAMQGGNSGVRKREEEGDGAGAVAAPPAIDFPAEGPDPEYDESDVPAEIQVSKRTPYNSQPSLLQLQSNSCWFLELEHLSHVHEPNPLRSRKVFKRTLPRR

SEQ ID NO: 788590 - protein, 110 aa, Homo sapiens
LSPVWVPLGRGRAGRGGGAGPLLGSQAPAPGTIETPSRTPLPGRPGLLAGGEGEGLGRVPLSGGRSVPARRRPRRLGCPPPSRYDAAAVPQGRGKSRGPASYPSQCPRLI

SEQ ID NO: 788591 - protein, 70 aa, Homo sapiens
HCPAPAPVVVPGLLSATKKPCAVNGHGVLSQSSSQPTGERGVSMNELEEHSGTKGPGTVAHTSNHSPLGG

SEQ ID NO: 788592 - protein, 111 aa, Homo sapiens
MDSHFQWRCWLWHILTPPLGTPPSVPCLAHFSLRAIFVVATSRKPSLILIPKACVGIRPTPSLCQLGSPGFLYAPPPGWVLGKYSQPPALSLACSCHSVSSLMRGSLLWED

SEQ ID NO: 788593 - protein, 124 aa, Homo sapiens
SFLHFLCMARSSGLQRLCIWGAATDEPVNQSHTRSVDAAWGALSARTGWENGGRWGQGEPVNFPERPPSQTQLRVLGFETWSSTQELSLTGRQRLHSEPSTEGRPAGRGGLDSPSTERSDVRWP

SEQ ID NO: 788594 - protein, 113 aa, Homo sapiens
MLARPLPAIRSTAAPERAATPRSPQELVRAPRGAEAREHAQRFLGNVVGCRIRTTNPGTHRAAAPTVRALSGESESRLSVTWGKLSKPNSIFTRGFLFGNMIAVSLVCAPGAL

SEQ ID NO: 788595 - protein, 114 aa, Homo sapiens
PDSLQNLHPPSYPLMQARQMSTLHRKQRQIRPFSLVSELPVVPVTHQGVIKQKMLQPPGGLFSLRPGPCKLTLPRLGDEKSPKMQEPGCPGDKLLIPEMSQNLKQCLGLPHQPK

SEQ ID NO: 788596 - protein, 72 aa, Homo sapiens
MGLVSPSGHFIDTSPEYQGLEVTLDPASCSHLVSLLKIPVTGSPHFHSLDISQSSSWKHLNECSMDKEYQRL

SEQ ID NO: 788597 - protein, 109 aa, Homo sapiens
FKNRFLLCCLDQSHLLALSDPPASAFQNVRIMGMSYCAQPSVLVYSMTDQAGGNPVALIASKHHYPLLLSQEHCALRKDIASAKSRMRCQAADCKGACKRWQGSVVKSS

SEQ ID NO: 788598 - protein, 142 aa, Homo sapiens
MCLRTHSQSAATVRRHSTLLTPGSPASQARHSGGPGMDGLSDIYSLAKIQAGNAAPLEGRSRDPLSVRAFPQGLWNRSRSQSQLCLPQLCDLQPRRPSAGYPDVRGGAHRPCKEALVRSTCDAALNQCRPERREGGPGCGNS

SEQ ID NO: 788599 - protein, 291 aa, Homo sapiens
ATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELIS

SEQ ID NO: 788600 - protein, 104 aa, Homo sapiens
ATYVENLRLLRACFEETKKEEIKEVPFETLAQWNLEHATLNEAGNFLVEVSNDVVGSSISKELRRLNKRWRKLVSKTQLVSSFDWLQLYLDMIHVPHNLLIVSS

SEQ ID NO: 788601 - protein, 106 aa, Homo sapiens
NYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 788602 - protein, 79 aa, Homo sapiens
MIELGTTTSIDEVGVVNSEREYRAVTSMLSPVSRRVIFHQDKRRMEAKSDPSGLCHLTGIHPCCEQFTTQFCTLQMLKS

SEQ ID NO: 788603 - protein, 71 aa, Homo sapiens
IRRLEHKACDLPRDDLKLEMSVSATQIETAKSEKNKDMRMTGTKTKPRVPVWGWRGEQNSSPPPVNAFAQS

SEQ ID NO: 788604 - protein, 138 aa, Homo sapiens
NQQVRCPAVAVHRSALEGEVHAAVHAQPPPFPHSTLGAHQTCTGELGKEADDACRGGSCGDLSTESPSEANRPQRHPPGTAIPTAVHLVLGPRTPRHLAPNPFISKSLTILTIQPDIHNCSGVSVDACVQYYPGIRKK

SEQ ID NO: 788605 - protein, 751 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRNCIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKVRSAVSNNQASKKHLCLRKEPQSSLGSWNPISQENNENKMISFVKDIMKPNIFYSMH

SEQ ID NO: 788606 - protein, 801 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRRELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKLRKSVFSIRARNLLEKETAVTKILSKRPLPTSSPISIRCCLYLGRSHCHSSGVRMYRLFPHPCSGTLRKKTWRQRRKEPGTPCYCVYKQLVVFKG

SEQ ID NO: 788607 - protein, 801 aa, Homo sapiens; identical to SEQ ID NO: 788606

SEQ ID NO: 788608 - protein, 786 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRRELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKLRKSVFSIRARNLLEKETAVTKILRACTRQRMLSGSFEGQPAKERSILSVQHHIRQERRSLRHGSNSQRISRGKSLETLT

SEQ ID NO: 788609 - protein, 90 aa, Homo sapiens
AFKILFVRFIEFLRTQERHQQRAMIVIARCTVTSIHTALTLPFQSHGVYRSVLLTASCLFHNAYCKTSSTQNAPTQLLVELQPDDGSTRN

SEQ ID NO: 788610 - protein, 436 aa, Homo sapiens
AERLTPTKALSEGSRPSSRCARRQGPSRGARAHGHLHPALSTPSSRAQHILAGTGRGVAWPQERTLALLLTPRAGSSRREDSHPTPSPVGNVVSETVWDPRAHGRLPGTRARRCLIGLPRVGPGETRTAGAASRHFARPEMFGSSRYLGSSEQPRANSLGPSDRTLVLCSLVEGEDKVNPSEPHGLRMEEKWLLKGKLRNQRNQNKLLSPNKKQRKNHTSKLQELALLLPIALKTGTKKLTKKEILVHVLQYIQYLQRNIDAAKALFKCHITTGEGGLAGLGQKPAWGPARRRRHSTPSSSPSSQKSCLQGACQKPRKKKLTQASESQTRTPKPRRSLALNKPEKLVAPSPDQKGSGTGGTTTPPRCPDSCGHPRPASSSPPGDRKGGQSQLTLLDLAEDTIHCDISSCWCQGSVQDDAPFPALLAQEDVARIHFL

SEQ ID NO: 788611 - protein, 177 aa, Homo sapiens [sequence omitted]

SEQ ID NO: 788612 - protein, 223 aa, Homo sapiens
AHTDRSPRMCTEGAFPHRSACSLPLTHVHTHIHVCVPVLWGSVPRGMKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMSSA

SEQ ID NO: 788613 - protein, 81 aa, Homo sapiens
GSNKKYRALRLDVGEFSWGSECCTRKTRIIDVVYNASNNELVRTKTLVKNCIVLIDSTPCRQWTPEEEEILAFFFLSSYFF

SEQ ID NO: 788614 - protein, 156 aa, Homo sapiens
HAATTLLILHRYRLNEGFLLGLDPLLAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 788615 - protein, 130 aa, Homo sapiens
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVTSDSDKEKTIAFLLKELDILRTSNKKV

SEQ ID NO: 788616 - protein, 130 aa, Homo sapiens; identical to SEQ ID NO: 788615

SEQ ID NO: 788617 - protein, 261 aa, Homo sapiens
MSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 788618 - protein, 155 aa, Homo sapiens
MSRLQLAIEERDEAIARAKHMEMSLKVLENINPEENDMTLQELLNRINNADTGIAIQKNGAIIVDRIYKTKECKMRITAEEMSALIEERDAALSKVNEGFLLGLDPLLAKLLSMQQARETAVQQYKKLEEEIQTLRVYYRFVCEKEKKDFVLGYV

SEQ ID NO: 788619 - protein, 141 aa, Homo sapiens
MSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKVNLRSFLQAN

SEQ ID NO: 788620 - protein, 254 aa, Homo sapiens
RGGGAMPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGPCVVGYGIYYFIYSTWKGRTIYLEDIYVMPEYRGQGIGSKIIKKVAEVALDKGCSQFRLAVLDWNQRAMDLYKALGAQDLTEAEGWHFFCFQGEATRKLAGK

SEQ ID NO: 788621 - protein, 220 aa, Homo sapiens
RGGGAMPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGQGIGSKIIKKVAEVALDKGCSQFRLAVLDWNQRAMDLYKALGAQDLTEAEGWHFFCFQGEATRKLAGK

SEQ ID NO: 788622 - protein, 254 aa, Homo sapiens; identical to SEQ ID NO: 788620

SEQ ID NO: 788623 - protein, 144 aa, Homo sapiens
EGVGLCPDRGSPRWPTLSSRTAPESQLHLPGRGYPAVPPDSRHPALSGSSGSKSVGPLRGLVAVCEALGLWSQTAGIRMASVRIREAKEGDCGDILRLIRVKTAGRAGNPGVRVARPERGRRRRGQGEGLALGTCSGSSGALLL

SEQ ID NO: 788624 - protein, 224 aa, Homo sapiens
RGGGAMPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGPCVVGYGIYYFIYSTWKGRTIYLEDIYVMPEYRGTGQKLRLGWEQSTPQTPLLSPVPRAQPVSFSDPLQLKQ

SEQ ID NO: 788625 - protein, 224 aa, Homo sapiens; identical to SEQ ID NO: 788624

SEQ ID NO: 788626 - protein, 144 aa, Homo sapiens; identical to SEQ ID NO: 788623

SEQ ID NO: 788627 - protein, 144 aa, Homo sapiens; identical to SEQ ID NO: 788623

SEQ ID NO: 788628 - protein, 144 aa, Homo sapiens; identical to SEQ ID NO: 788623

SEQ ID NO: 788629 - protein, 144 aa, Homo sapiens; identical to SEQ ID NO: 788623

SEQ ID NO: 788630 - protein, 144 aa, Homo sapiens; identical to SEQ ID NO: 788623

SEQ ID NO: 788631 - protein, 199 aa, Homo sapiens
RGGGAMPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGPCVVGYGIYYFIYSTWKGRTIYLEDIYVMPEYRGQGIGSKIIKKVAE

SEQ ID NO: 788632 - protein, 180 aa, Homo sapiens
EGVGLCPDRGSPRWPTLSSRTAPESQLHLPGRGYPAVPPDSRHPALSGSSGSKSVGPLRGLVAVCEALGLWSQTAGIRMASVRIREAKEGDCGDILRLIRVKTAGRPESRWLWRQSFLSLFGSRDSSSAREATGALRGGLWDILFHLQYMEGTHHLSGGYLCDAGISGSRDWFQNNQKGG

SEQ ID NO: 788633 - protein, 120 aa, Homo sapiens
KYPILSMDYFLKKTPISEEALRADGFGDNPFYHCLVAEILPAPGKLLGPCVVGYGIYYFIYSTWKGRTIYLEDIYVMPEYRGTGQKLRLGWEQSTPQTPLLSPVPRAQPVSFSDPLQLKQ

SEQ ID NO: 788634 - protein, 165 aa, Homo sapiens
RGGGAMPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGQGIGSKIIKKVAE

SEQ ID NO: 788635 - protein, 213 aa, Homo sapiens
RGGGAMPGQRIASLAYSLLPYGAGIPAPLTRPRLPRRPPRLPPPRSLRLFRIQVRRPFKGSSCRLRGPGTLVPDSGDPDGFRADPRGQGGRLWRYPEADSGEDCRPELAEFEKLSDQVKISEEALRADGFGDNPFYHCLVAEILPAPGKLLGPCVVGYGIYYFIYSTWKGRTIYLEDIYVMPEYRGQGIGSKIIKKVAESWTGTRGPWTCTRP

SEQ ID NO: 788636 - protein, 224 aa, Homo sapiens; identical to SEQ ID NO: 788624

SEQ ID NO: 788637 - protein, 103 aa, Homo sapiens
MVLDPLISSEHLPSSPSVTCIYRFTKKSLSSPLCHLQILSVPSSTTYCGSSQPECSTFYFQLTTISQALATASPLDYCVVPRLVVFRFATYTPFFTQQSEDHL

SEQ ID NO: 788638 - protein, 147 aa, Homo sapiens
PALMEHTLHIDPHATPTTKPCSLLQGQGGRGGSTLTGGTCKVVLVQAPSSGLGQMRPVHAEASLARGLHCLCSFLFLCSVERRSLWPHTSRCPCTSSWATQQNSRALSMAFGWGPCQSSMSPEAPGAFSHLGIVRGDFFLIKSLPWS

SEQ ID NO: 788639 - protein, 69 aa, Homo sapiens
GTLELKVDSSGPCSLACRVKDLGLGLSLLRPQGAGQHGWWECGGDTQHIHMLPECHVGSGWFLHSNSAS

SEQ ID NO: 788640 - protein, 198 aa, Homo sapiens
FCERCEQSFAEPTLLALHQCSETHIQPVQGLSSPPCSVELPPSNPTLPGPLQGQSPPVSPLSCPVCRQEFAQPQALKSHFKIHRGTPDTFSCPESGCVFSAEDRKGLQHHLRQTHRAVPVPCSFRGCPLLFGSQQGMELHRQAHYPFHCSHCSFIGSNVKLFRQHQRSHGAGTQGELSAVQGLPSQELLPGMRPRAKQ

SEQ ID NO: 788641 - protein, 100 aa, Homo sapiens
WSYSRMADPLKVYPPLKGSFPENLRHLKNDHRGRFWRFRVGGTGGAPWTLEQDRPRLQCQPTPHITSVCLDRRFNPSLRIPICKMGITRPTMAQNERRPN

SEQ ID NO: 788642 - protein, 66 aa, Homo sapiens
TESSLSPIPQHVFHVPDPSDDLTLLFLTTVLYPWSTLPLLQVVAVTCPTWCHCGTFFLTSVCGMDD

SEQ ID NO: 788643 - protein, 183 aa, Homo sapiens
LISVQKKELPETLMTDGARLQELTEKLNQLKIIACLSLITNNMVGAITGGLPELASRLTRISAVLLEGMNKETFNLKEVLNSIGIQTCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYG

SEQ ID NO: 788644 - protein, 101 aa, Homo sapiens
SSGTMRSWAFNCCRSDLAHSSGSNCQFQDARCRASPAWASPAEGPEKGPQALGRGWSESMGLGGRKDLGQGNRWSYRAEPDQQRAFPETLRPSLLLPQRLW

SEQ ID NO: 788645 - protein, 101 aa, Homo sapiens
EPLYINTCFLSVFDLLKVKLLVSITTTPGNSQRNTFGQNFPLKSLLFVHIYVSVNKSKYIYHLIVCLELRQPWRFTAKTVPLYMMAYHLGKETAALPRTQN

SEQ ID NO: 788646 - protein, 150 aa, Homo sapiens [sequence omitted]

SEQ ID NO: 788647 - protein, 123 aa, Homo sapiens
MVELLVCRAPDGINSRRDCPRKSPADFSPKLSSGSPAVTVGKHLGVFLGSIRSSSPKGSTANSTLYLPQLSQELAPVAIWVSLDASFRDVTQMATRSYLLLLVCQDCSQVNGSFSFSPDSTTD

SEQ ID NO: 788648 - protein, 90 aa, Homo sapiens
QSTEVKMWAEERSTCSSHLLVVGTYYSSIAIAYVAYRADLPLDFHVMGNVVYAILTPVLNPVIYKLRNKDVKAAITKIACPQEPKNARKP

SEQ ID NO: 788649 - protein, 113 aa, Homo sapiens
MAKPYEFNWQKEVPSFLQEGTVFDRYEEESFVFEPNCLFKVDEFGFFLTWRSEGKEGQVLECSLINSIRSGAIPKDPKILAALEAVGKSENDLEGRIVCVCSGTDLVNISFTY

SEQ ID NO: 788650 - protein, 113 aa, Homo sapiens; identical to SEQ ID NO: 788649

SEQ ID NO: 788651 - protein, 84 aa, Homo sapiens
GRQASRPATPAATQRRCVPAAWWSFVEARQAWARRSSGRAGSRLREADAAVSHRDGGNHFDQHDEGQFTLSQQKQGTLWGAGGQ

SEQ ID NO: 788652 - protein, 87 aa, Homo sapiens
GRQASRPATPAATQRRCVPAAWWSFVEARQAWARRSSGRAGSRLREADAAVSHRDGGNHFDQHDEGHLETEQASLDKPTESIRWIIA

SEQ ID NO: 788653 - protein, 169 aa, Homo sapiens
MREIVHLQAGQCGNQIGAKFWEVISDEHGIDPTGTYHGDSDLQLERINVYYNEATGGKYVPRAVLVDLEPGTMDSVRSGPFGQIFRRKLRFGQSGAGNNWAKGHYTERRELVDSVLDVVTKEGEECDCWTGSRLNQPGGRRSEVPPHRTAETNGPHLRGASNVKQGQTP

SEQ ID NO: 788654 - protein, 142 aa, Homo sapiens
MREYKLVVLGSGGVGKSALEQFTAMRDLYMKNGQGFALVYSITAQSTFNDLQDLREQILRVKDTDDVPMILGGNKCDLEDERVVGKEQGQNLARQWNNCAFLESSAKSKINVNEIFYDLVRQINRKTPVPGKARKKSSCQLL

SEQ ID NO: 788655 - protein, 184 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILGGNKCDLEDERVVGKEQGQNLARQWNNCAFLESSAKSKINVNEIFYDLVRQINRKTPVPGKARKKSSCQLL

SEQ ID NO: 788656 - protein, 74 aa, Homo sapiens
IPTLLGLPRCIHHMKYPIICRLIHFPNSSNINNFHDLRSLRFKAKSPNNRRTLHKPGVTIWMRPTLPHIRRTRI

SEQ ID NO: 788657 - protein, 136 aa, Homo sapiens
PPGCRNWHEGCVIETGSCSATQAGVQLKQDIPLTPSWVLRLRCLTYLAHGSQLLAGGGARVNEAGTGVLEATNSSHPGLLRSTLYGRVRGGEQMLEPERALLVAGRSELHAGPAAVSRGCPRPLKTHSLSYNLSWL

SEQ ID NO: 788658 - protein, 136 aa, Homo sapiens; identical to SEQ ID NO: 788657

SEQ ID NO: 788659 - protein, 33 aa, Homo sapiens
MESTWKLAGPEWALDVWGRGPNCPLLASSPGAP

SEQ ID NO: 788660 - protein, 161 aa, Homo sapiens
MEEFDLVKTLHKTSSSVGSDENSLHSLGLNLNTDRSSPHLSTNGVSSFSGKTRPSVIQGTVEVLTSLMQELQNSGKTDSELWKNCEHIQEEIKNLVKLQTSSASLASCEGNSSNKQVSSESQMGFYSLSSERNESVIHYPESTEPEIQQEMSTSQPDCNVD

SEQ ID NO: 788661 - protein, 191 aa, Homo sapiens
MEEFDLVKTLHKTSSSVGSDENSLHSLGLNLNTDRSSPHLSTNGVSSFSGKTRPSVIQGTVEVLTSLMQELQNSGKTDSELWKNCETRWLQLFNLVEKQCQEQIVAQQEQFHNQIQHIQEEIKNLVKLQTSSASLASCEGNSSNKQVSSESQMGFYSLSSERNESVIHYPESTEPEIQQEMSTSQPDCNVD

SEQ ID NO: 788662 - protein, 124 aa, Homo sapiens
MQELQNSGKTDSELWKNCETRWLQLFNLVEKQCQEQIVAQQEQFHNQIQHIQEEIKNLVKLQTSSASLASCEGNSSNKQVSSESQMGFYSLSSERNESVIHYPESTEPEIQQEMSTSQPDCNVD

SEQ ID NO: 788663 - protein, 86 aa, Homo sapiens
GTHLVGVTCCFGPSVPSRSRRRPQSPEPSPAQARPPHPRPAPGRPTGGRDRVLLGSFRSFNIYSTKNTKSALYKLMEGYSYANIEH

SEQ ID NO: 788664 - protein, 104 aa, Homo sapiens
ARARPRAVPGSPEGAVRGRRSGAGGVTRGRGAHRDRGSQPGPTVSSDASEISLRVCFFGASPEPDSGTGLSACCSLSFNIYSTKNTKSALYKLMEGYSYANIEH

SEQ ID NO: 788665 - protein, 117 aa, Homo sapiens
MNAVGMNAEGLFFQVVGSLLAQDVSKNVIWQCPAISLYHAPSTGIGGGVAPAIQDCFLNHSSASFSNMKVKPEWTNGQIAGKEEEERKKEEVEEEEKEKEEQGRRKMKNKKRKGFNV

SEQ ID NO: 788666 - protein, 160 aa, Homo sapiens
MTNTKGKRRGTRYMFSRPFRKHGVVPLATYMRIYKKGDIVDIKGMGTVQKGMPHKCYHGKTGRVYNVTQHAVGIVVNKQIKGKILAKRINVRIEHIKHSKSRDSFLKRVKENDQKKKEAKEKGTWVQLKRQPAPPREAHFVRTNGKEPELLESIPYEFMA

SEQ ID NO: 788667 - protein, 160 aa, Homo sapiens
MSAISRALPEKRAVPAKGVASQTCQTTNPLGTSTHPWSRLWGTLCSMSKWSPGPLPSSVACASWTRSSRSVMKMAAQLRSALPSAGLRDAQLPRAGHPNNSIPFSSASPQAAWERKLPSSSSAHTKCPAGIFFPVTVAPGRHTWPDTAESQARSCWHCFH

SEQ ID NO: 788668 - protein, 159 aa, Homo sapiens
QCLGMAFPARARLTPCTPALKKEDFQGKDGNLCLHVPNPPSGISFPSVVDHPMPEERASKYENYFSASERLSLKRELSWYRGRRPRTAFTQNQIEVLENVFRVNCYPGIDIREDLAQKLNLEEDRIQIWFQNRRAKLKRSHRESQFLMAKKNFNTNLLE

SEQ ID NO: 788669 - protein, 185 aa, Homo sapiens
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYRGRRPRTAFTQNQIEVLENVFRVNCYPGIDIREDLAQKLNLEEDRIQIWFQNRRAKLKRSHRESQFLMAKKNFNTNLLE

SEQ ID NO: 788670 - protein, 185 aa, Homo sapiens; identical to SEQ ID NO: 788669

SEQ ID NO: 788671 - protein, 30 aa, Homo sapiens
MPSWPLGARPARSKTHAHVGVVDGEERGVA

SEQ ID NO: 788672 - protein, 162 aa, Homo sapiens
SKGRGEEGEPDRYYPDSSLDVMGLLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 788673 - protein, 157 aa, Homo sapiens
MQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 788674 - protein, 144 aa, Homo sapiens
KTIRDGSTGPDTVVMNPVSYLYPKRSAQGLTALDSQMITRMDRGGRMRTDPTSQMAFPGSFTGSLSNRESTRTSMSVYPDPQYKHLPTGPHSISYTYLAEPILWASPIWFPAWCTLPPSLGPLSIINPLISFTSPSIIPTAMLE

SEQ ID NO: 788675 - protein, 103 aa, Homo sapiens
MHQYDKAGPCHKFPFITFPGSALVKFNEITSCLLFVYPDPQYKHLPTGPHSISYTYLAEPILWASPIWFPAWCTLPPSLGPLSIINPLISFTSPSIIPTAMLE

SEQ ID NO: 788676 - protein, 119 aa, Homo sapiens
HFYLFVHLLHTHAVPGPGLLSGDAAASMTQCLSQELSHILRQHPPPPSLEPWLLMKILHHLLLLQSCLSRHHLPWDPAELLQGIRKCPRLGSWCPRFEGTLGKILGLSFPTCHGRGQPG

SEQ ID NO: 788677 - protein, 74 aa, Homo sapiens
MHSCGLFILMAVLRSAGIDHTSSICQVIPCMVLTLFLPLSITSGILPYQQILCMLFPKWKHNILITIPLGTLRL

SEQ ID NO: 788678 - protein, 105 aa, Homo sapiens
TETTVTVTTEPENRSLTIKLPKRKPEKKVEWTSDTVDNERMRRRSSKCCSIYEKSRAFGESSTESDEEEEEGCGHTHCVRGHRKGWRPATLGPTPTTPPRPPDPS

SEQ ID NO: 788679 - protein, 85 aa, Homo sapiens
PLRLTRNIHSVGLLRLTHCTCRAGSLSLTRRTRRAGSLSLTRRTRRTCRIRHAGPLRLTHRTRCAGSLCLTRRTRLMGVGSSCAC

SEQ ID NO: 788680 - protein, 75 aa, Homo sapiens
GDQPMGTASREQPLKASLDPGTRVSLVFEGRGEGERSPELARDNRAPGGGGEDCACLTLQPLLGPLGKRPSSETN

SEQ ID NO: 788681 - protein, 106 aa, Homo sapiens
ANRPGPLLQWVPESAQTLGFESLSPKGKGQTLPESWGPPCLNASSKSCHLSREGDWPTALGVRQFSFIFETEFRSCCPDWSAVARSQLTTTSASWVQVIHLPQPLE

SEQ ID NO: 788682 - protein, 344 aa, Homo sapiens
RRCAGKPVFWFAMARTKQTARKSTGGKAPRKQLATKAARKSAPATGGVKKPHRYRPGTVALREIRRYQKSTELLIRKLPFQRLVREIAQDFKTDLRFQSSAVMALQEASEAYLVGLFEDTNLCAIHAKRVTIMPKDIQLARRIRGERAEEVAVRPEVPSYPKGSFQSHPHQHLEEAVPLALRAPPALERGRHFRLGSQQNGVGSPCCGAVLSFADFGQLAYPHWPGCGRFPGRRLAGFGGPAPPARDRGPAWRGGRGRRDGASGTRPGVTRGTLRARGPERGWPLRKWSATRPCFAPKPASPGAAIRLGREMTTSASPGFCGQTWGELRWGCRSVPAPPPLAQW

SEQ ID NO: 788683 - protein, 104 aa, Homo sapiens [sequence omitted]

SEQ ID NO: 788684 - protein, 196 aa, Homo sapiens
MEASRRFPEAEALSPEQAAHYLRYVKEAKEATKNGDLEEAFKLFNLAKDIFPNEKVLSRIQKIQEALEELAEQGDDEFTDVCNSGLLLYRELHNQLFEHQKEGIAFLYSLYRDGRKGGILADDMGLGKTVQIIAFLSGMFDASLVNHVLLIMPTNLINTWVKEFIKWTPGMRVKTFHGPSKDERTRNLNRIQQRNG

SEQ ID NO: 788685 - protein, 267 aa, Homo sapiens
KFKLQTLSSKLQAPSSKLQTPAGVTGTQSEGHGGIPKVSGSRGLEPRAGCSLPKGLAVSPRLEFSGLIIVHCSLELLELKQSSCPSLPSSWDLRYVKEAKEATKNGDLEEAFKLFNLAKDIFPNEKVLSRIQKIQEALEELAEQGDDEFTDVCNSGLLLYRELHNQLFEHQKEGIAFLYSLYRDGRKGGILADDMGLGKTVQIIAFLSGMFDASLVNHVLLIMPTNLINTWVKEFIKWTPGMRVKTFHGPSKDERTRNLNRIQQRNG

SEQ ID NO: 788686 - protein, 133 aa, Homo sapiens
SLQRWEKDEELGQLSTISPVLYANINFPNLKQDYPDWSSRCKQIMKLWRKVPAADKAPYLQKAKDNRAAHRINKVQKQAESQINKQTKVGDIARKTDRPALHLRIPPQPGALGSPPPAAAPLLILTNKFYFLS

SEQ ID NO: 788687 - protein, 147 aa, Homo sapiens
DPSGYLLIPLVSTKILIFIWLWSTDAVPIVISLSSHMASRSSGSWVTLSLLGPPGNLFMAAGSPTCLDTPGNQVAFPTREGPGSGFLLLSSTLLRNTAQDASAFGFLEFIWGFSHPLMGLTPLLPLHSLLPPTMRVSCRLGVNEGRI

SEQ ID NO: 788688 - protein, 34 aa, Homo sapiens
KKKKTILNVGNDVKQLELPHTANGKASLTISYKV

SEQ ID NO: 788689 - protein, 109 aa, Homo sapiens
PNRYNSARISKKHRSVMIWESRAECKLDFALHLEKNVNQSLLELHKLATDKNDPHLCDFIETHYLNEQVKAIKELGDHVTNMHEMGAPESGVAEYLFDKHTLGDSDNES

SEQ ID NO: 788690 - protein, 103 aa, Homo sapiens [sequence omitted]

SEQ ID NO: 788691 - protein, 102 aa, Homo sapiens
TSWIRPLPSILLAPTLIPPGPHLDQGNHLLSGPHASKFLQATRVITSKEKSYHGTCLHKMLQGLPAAIEDPSLKLDIVTLCDLVLLSPPLASHFMLQQSPAV

SEQ ID NO: 788692 - protein, 106 aa, Homo sapiens
MHVWAPGAAGPEPLTVPGSLLLQRQGRLPESLLACWLHQRFLFFQFSSPLFLAPFSASRTPASSKTHSIIPQNSWKRTADPSPCWSPSPEHSLGHTCGATVSVGLT

SEQ ID NO: 788693 - protein, 199 aa, Homo sapiens
MHYCTLSTQKKLPACADNNFDFIKITAKVIHTYRTLYTYGYNRGVTNFQFSIVSVHSTLCNNLRIRYAGHTEQITDRLHVPLEAESCPKLNTSHGALRGTSRSARTIHTTTTPNSLKKGKASNPIKQTPTQPHTKQPHNKAPLPKTTPEHADNNVNPKRGTRQRHDNSRNKDKTPTQPREHLEHYDTTTQTRNNNTESN

SEQ ID NO: 788694 - protein, 124 aa, Homo sapiens
MQTIFELTLQASDQGFNLLSVILNLHVMVDDHCKNARTLCQELQPSGALFDAAPLTMQPSYPITKVDTSWGIKADCPIMCFRPANVALQTRDVHELDACRVTVGNRDATCQGLLVTVVNGESSR

SEQ ID NO: 788695 - protein, 42 aa, Homo sapiens
DGGERIGGLCARAPGGSRDDARLDAPPRLKALPVSLIRRERV

SEQ ID NO: 788696 - protein, 83 aa, Homo sapiens
PALGSLQSPQLPRAACPGAPALFQPGERLGGEHGTAREAEAGALGARYLRTGEAAPIPRAGTQGKARTGRPAEGRAPLISHAS

SEQ ID NO: 788697 - protein, 95 aa, Homo sapiens
MARELSQEALLDFLCQAGGRVTNAALLSHFKSFLRDPDASPSQHQHRRELFKGFVNSVAAVRQDPDGTKYVVLKRRYRDLLGEEGLQRPREPPAA

SEQ ID NO: 788698 - protein, 48 aa, Homo sapiens
WKINFRKKVIHCEQGRLAASWSGDPGPTGPLTLGESLPKLGVRYHSTP

SEQ ID NO: 788699 - protein, 237 aa, Homo sapiens
MRNIKYKPVDYQQLRALTEAKKLASASAKLKIRKAMLTSKLSKEQTLIKQHKQVWWQEYQRLNEVRCKMESEIKSLLNEENIGNECLCDLTNFEQELSEQQCTYLKNVINPIQQLRADLKYRQHHTLQHSHPHIEFNSVKVLEEVDFVKKQLKTVFERLRLEQQRIENDLSDWSIKILDHSLEEKTNPLSELPIELESLECPYPDLKSSILSEFYKFTQKYQKKLQDFNLQLEDIYR

SEQ ID NO: 788700 - protein, 503 aa, Homo sapiens
MRNIKYKPVDYQQLRALTEAKKLASASAKLKIRKAMLTSKLSKEQTLIKQHKQVWWQEYQRLNEVRCKMESEIKSLLNEENIGNECLCDLTNFEQELSEQQCTYLKNVINPIQQLRADLKYRQHHTLQHSHPHIEFNSVKVLEEVDFVKKQLKTVFERLRLEQQRIENDLSDWSIKILDHSLEEKTNPLSELPIELESLECPYPDLKSSILSEFYKFTQKYQKKLQDFNLQLEDIYRNCQLSEEDHWIYQAILDQYPGDLFGRRTLYLDMLQRYFPHKSRHDLVEHEKYCDQYRFAIEQQNILISNWNKNRKDFIQKAVLTLTEACATHEMESMLAKDKKKQQELCADLKAKVRQWRAHQEEVARLEMEISARRREKEEEKEKLWKKKELLQRAEKKKKIKKYWAKKKQKWQEMEMRDLQRLEELKKLIAEQSLKDRERVKYRQELLAKAFDRQHTRKWPFKKLMKTKKRARRLEALKEHRLPVLPQLILSGHDVQIHWPSQG

SEQ ID NO: 788701 - protein, 102 aa, Homo sapiens
RSFFMHLFRANKAKKQKASKALVEGVHYYVVDHPPSLRCFGKFLIFAISLAMLPCLVLNSWAQAILPLWPLKVLRLQVSLSAQPTGSFLKPMLSNCFPEKLF

SEQ ID NO: 788702 - protein, 69 aa, Homo sapiens
GAGSGLGHPRKGLPQCSGGLKGSSSAARVGAEAKEAPRAREGCQHTHLSPSTQEAEAGESLEPGRRRLQ

SEQ ID NO: 788703 - protein, 107 aa, Homo sapiens
SRESPTFPLVVNVSPSQFIKWTVTLSSELLRAPADTLSGRLASALRPGPRLLSRPLAPARDPAWCSHRPAGSPRTAEAARSSRAPPAAAIARGRELKRNYLKIVLTL

SEQ ID NO: 788704 - protein, 120 aa, Homo sapiens
LQWWPGEWVGCLPISLPPHRRTPSVEEEREDEYTGSLRSQLLFTMEPPQFRPHNHCRRRSKSLGLLPLPSARKAVTHRSRGCLHPEVTQSDPFACLMPVIPELWDAEAGGRFEARDLRLH

SEQ ID NO: 788705 - protein, 119 aa, Homo sapiens
MKEDHMSILDTYCMNVFALSDLGTWVPWDRGSAEQRKPTCATEKAAQATGTGQECSQECPLNLNLISRHHLPPLNQHLLDSQPSVSMIPAIPDARRLATLGSSSRCVLNLQKASFPNDQ

SEQ ID NO: 788706 - protein, 530 aa, Homo sapiens
MISAPDVVAFTKEEEYEEEPYNEPALPEEYSVPLFPFASQGANPWSKLSGAKFSRDFILISEFSEQVGPQPLLTIPNDTKVFGTFDLNYFSLRIMSVDYQASFVGHPPGSAYPKLNFVEDSKVVLGDSKEGAFAYVHHLTLYDLEARGFVRPFCMAYISADQHKIMQQFQELSAEFSRASECLKTGNRKAFAGELEKKLKDLDYTRTVLHTETEIQKKANDKGFYSSQAIEKANELASVEKSIIEHQDLLKQIRSYPHRKLKGHDLCPGEMEHIQDQASQASTTSNPDESADTDLYTCRPAYTPKLIKAKSTKCFDKKLKTLEELCDTEYFTQTLAQLSHIEHMFRGDLCYLLTSQIDRALLKQQHITNFLFEDFVEVDDRMVEKQESIPSKPSQDRPPSSSLEECPIPKVLISVGSYKSSVESVLIKMEQELGDEEYKEVEVTELSSFDPQENLDYLDMDMKGSISSGESIEVLGTEKSTSVLSKSDSQASLTVPLSPQVVRSKAVSHRTISEDSIEVLSTCPSEALIP

SEQ ID NO: 788707 - protein, 174 aa, Homo sapiens [sequence omitted]

SEQ ID NO: 788708 - protein, 150 aa, Homo sapiens
GTTMNTDSLFVVLHQDSAKTLVTVFLGVFFTPRIPPQSAFLQFFLHTEHQRSFQRVLSPGLKPSCGPHSSRSVRLLGSFLWGSCCHPLTYPATAASGPLNMPCVSFTQGKLLTLYPKDREPLQCELCSEIMCYPSTPHSSQLLTSSSSST

SEQ ID NO: 788709 - protein, 89 aa, Homo sapiens
ELTRGSQHITLILSGMAVDASHCHWDYSLHFSFMRVNSLKTELHIYYYGAVNSANLVSFIRGSSSSNAPPAQMLYSLPSLITSCFSFTH

SEQ ID NO: 788710 - protein, 100 aa, Homo sapiens
CSLGLRLRYPGAQVTAAATQEPRSSPLSHPCVQTSRISATSAPARQPPQEPGTRSLAVRRRGPSWEFGPKREGKEAGRRIGSAEEPAGWRAKKFIFWMPM

SEQ ID NO: 788711 - protein, 108 aa, Homo sapiens
CSLGLRLRYPGAQVTAAATQEPRSSPLSHPCVQTSRISATSAPARQPPQEPGTRSLAVRRRGPSWEFGPKREGKEAGRRIGSAEEPAGWRWALKWAWRRRGRWRCEYK

SEQ ID NO: 788712 - protein, 72 aa, Homo sapiens
YQILVTNAQFPAEIRNLEPVTQLYVSVDASTKDSLKKIDRPLFKDFWQSGRSIFFRLTLVKAVDRGFRGSLN

SEQ ID NO: 788713 - protein, 121 aa, Homo sapiens
MRSTRERRPQERRRQGSVRQGRTGGSRFAIIPGSRLCFVGPSHCILAHTGEFWPWENWSQHAAKLSHGRQRIPTHCRSKPCWKKQNSSPSVELRGDWSRAPADTKIQVAQVSHRKWRSICT

SEQ ID NO: 788714 - protein, 121 aa, Homo sapiens; identical to SEQ ID NO: 788713

SEQ ID NO: 788715 - protein, 80 aa, Homo sapiens
GRLEWVAIWAVARAGSTAYQDIPGGWALHQPQQHRCVTAQRARGQVWRGEHVHSDSGSCPQHPYFPALVYSRCAHLPSQC

SEQ ID NO: 788716 - protein, 199 aa, Homo sapiens
MENDFDELREEGFRRSNYSELQKEIQTKGKEVEKFEKNLDECITRITNTEKCLKELMELKAKARELREEYRSLRSQCDQLEERVSVMEDEMNEIEREKGNVQEEHTAIHRNRHNRLPRNLGDLCCHTDQIHRLTGVLQVTRSIGTQWTTTLADYFQENFPIQRRALSISDQNRQMPPQASDTTAAQLHYAPFGPTSSLE

SEQ ID NO: 788717 - protein, 72 aa, Homo sapiens
TLPHFSEIKYEDYQIGSLRIKKAEQGIELKYAWVPFTFPPLYFEEKRMEVNKQGIQEKYLNVEFTLCIDLGG

SEQ ID NO: 788718 - protein, 104 aa, Homo sapiens [sequence omitted]

SEQ ID NO: 788719 - protein, 38 aa, Homo sapiens
MRPRCWSPFPPTPRGPGILAFCHSSDSFLGDFTTSRIQ

SEQ ID NO: 788720 - protein, 144 aa, Homo sapiens
TDFWARFTSLNESITTKINKVSPSTDFISNPDNKTISPFFEPIDTKLSHMPVPPGLNSSKQLLNKTKGYNSRNHTSANEDEVSVTSKTWLVSVALCTSVIFLGCCIVILASGCCGKQQGQYKPGQRKSGSLQIKNRNHMKENSS

SEQ ID NO: 788721 - protein, 86 aa, Homo sapiens
ASFPNEDVRKCECKLCICKEESGRANGKVGLARIWRTLNAMPGGFEQEGRVVRFLPSRCPSTVEKISWSKRHCRGEIVRGQVEPSW

SEQ ID NO: 788722 - protein, 84 aa, Homo sapiens
IEGALKSKVPKTGIIHNVPLIAPLHSGDTSNRGSRLGSEGATPRPGHGAPLGLLEARKEGAKPPRAARAICRAPAGLRPAGGEG

SEQ ID NO: 788723 - protein, 67 aa, Homo sapiens
PGTGNVPGTPATEIPHILDWREKGYVTPVKDAEIYKLMLNTHVIGSGLRLRSEPQSDTLCGVSGNNR

SEQ ID NO: 788724 - protein, 111 aa, Homo sapiens
PIEDMTENKIFPYFEVGILFLSVFSRIGAFQQCRGSWNWLSCVLAVGGQDICSEGRQVCKGFIVKMFFIWLQNIHYVIKLAKGKQECMVSSGYFMEYLIEINVILDGYTSK

SEQ ID NO: 788725 - protein, 105 aa, Homo sapiens
MAHGSLRLLSLSKFSCLSLPSSWDYRCAPPRLANFCIFSRDGVSPCWPDCLEILTSGDPPTLASKSAGIKGVSHHARPILNFFGNCQNVFQNGYTIPFCISTTNV

SEQ ID NO: 788726 - protein, 46 aa, Homo sapiens
VHEMILGDLQMFLELLLLVTAWHSPEDNLFSPMPASVGLSTPAPPI

SEQ ID NO: 788727 - protein, 130 aa, Homo sapiens
MAAGVLPQNEQPYSTLVNNSECVANMKVYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCC

SEQ ID NO: 788728 - protein, 306 aa, Homo sapiens
MQVQDATRRPSAVRFLSSFLQGRRHSTSDPVLRLQQARRGSGLGSGSATKLLSSSSLQVMVAVSSVSHAEGNPTFPERKRNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCC

SEQ ID NO: 788729 - protein, 254 aa, Homo sapiens
MAAGVLPQNEQPYSTLVNNSECVANMKGNLERPTPKYTKVGERLRHVIPGHMACSMACGGRACKYENPARWSEQEQAIKGVYSSWVTDNILAMARPSSELLEKYHIIDQFLSHGIKTIINLQRPGEHASCGNPLEQESGFTYLPEAFMEAGIYFYNFGWKDYGVASLTTILDMVKVMTFALQEGKVAIHCHAGLGRTGVLIACYLVFATRMTADQAIIFVRAKRPNSIQTRGQLLCVREFTQFLTPLRNIFSCC

SEQ ID NO: 788730 - protein, 123 aa, Homo sapiens
PEATQPKPGGWPSQKGRASTARGRRSLELVDRAADRGADARRGRPLGTAGGAVSVAMTDQTYCDRLVQDTPFLTGHGRLSEQQVDRIILQLNRYYPQILTNKEAERLSSGTPRHPCVCGSVTS

SEQ ID NO: 788731 - protein, 123 aa, Homo sapiens; identical to SEQ ID NO: 788730

SEQ ID NO: 788732 - protein, 115 aa, Homo sapiens
PEATQPKPGGWPSQKGRASTARGRRSLELVDRAGGRPLGTAGGAVSVAMTDQTYCDRLVQDTPFLTGHGRLSEQQVDRIILQLNRYYPQILTNKEAERLSSGTPRHPCVCGSVTS

SEQ ID NO: 788733 - protein, 123 aa, Homo sapiens; identical to SEQ ID NO: 788730

SEQ ID NO: 788734 - protein, 108 aa, Homo sapiens
PEATQPKPGGWPSQKGRASTARGRRSLELVDRAADRGADARRGRPLGTAGGAVSVAMTDQTYCDRLVQDTPFLTGHGRLSEQQVDRIILQLNRYYPQILTNKEAERLR

SEQ ID NO: 788735 - protein, 275 aa, Homo sapiens
PEATQPKPGGWPSQKGRASTARGRRSLELVDRAADRGADARRGRPLGTAGGAVSVAMTDQTYCDRLVQDTPFLTGHGRLSEQQVDRIILQLNRYYPQILTNKEAERLRCHVQGYPEGWGISWNNEVGPQQNRSQHGPCYWLQFRNPKASLRVRLCDLLSHLQRSGERDCQEFYRALYIHAQPLHSRLPSRHALQNSDCTELDSGSQSGELSNRGPMSFLAGLGLAVGLALLLYCYPPDPKGLPGTRRVLGFSPVIIDRHVSRYLLAFLADDLGGL

SEQ ID NO: 788736 - protein, 123 aa, Homo sapiens; identical to SEQ ID NO: 788730

SEQ ID NO: 788737 - protein, 144 aa, Homo sapiens
MIFPGTPLYPQFRNPKASLRVRLCDLLSHLQRSGERDCQEFYRALYIHAQPLHSRLPSRHALQNSDCTELDSGSQSGELSNRGPMSFLAGLGLAVGLALLLYCYPPDPKGLPGTRRVLGFSPVIIDRHVSRYLLAFLADDLGGL

SEQ ID NO: 788738 - protein, 194 aa, Homo sapiens
ERVSHTLPTLPTSVALAPPLSHLFLDRCHVQGYPEGWGISWNNEVGPQQNRSQHGPCYWLQFRNPKASLRVRLCDLLSHLQRSGERDCQEFYRALYIHAQPLHSRLPSRHALQNSDCTELDSGSQSGELSNRGPMSFLAGLGLAVGLALLLYCYPPDPKGLPGTRRVLGFSPVIIDRHVSRYLLAFLADDLGGL

SEQ ID NO: 788739 - protein, 123 aa, Homo sapiens; identical to SEQ ID NO: 788730

SEQ ID NO: 788740 - protein, 117 aa, Homo sapiens
LAPPLSHLFLDRCHVQGYPEGWGISWNNEVGPQQNRSQHGPCYWLRCFFRFEGGTVILKVRSSNPNLLLLQLKSNACSLLKSLESLRRLYKKKHIFLPHRHHSSCHPSACHFHTAMV

SEQ ID NO: 788741 - protein, 208 aa, Homo sapiens
STARGRRSLELVDRAADRGADARRGRPLGTAGGAVSVAMTGGHGVGWAAGMRAPWMGGPARGSGCLASRLQAAPGQRGPSDLGPSAVGGARVHPREVVGVPGLLPGGAVPAEAVPGMMGGGQVRGPKRAGATRQLQGGAAQPRSGLSHCQCVCVPWWGIWSERVGGGRNDTGENSQRSCCDSGHGNNAPSLQPPQRGRGTGDAFLGGM

SEQ ID NO: 788742 - protein, 277 aa, Homo sapiens
MATSWFAPLGPVGATRDLLPLAGLSPPFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMESAPGTPSPAYPPWPVPGAPSWEHRPSPAIGRLPGHRPPGSDQRSAGQHGSLIWPGAAHSSPWTPLEVGTAGETLALHLCRHQTLALAGALAVLGCSGPLEERAAALRGLVELALALRPGAAGDLPGLAAVMGALLMPQVRGEQ

SEQ ID NO: 788743 - protein, 133 aa, Homo sapiens
SGLREWRGRRAGVAAGSFGFKALGVRARMRVWGGLGLGRVVKMPWAAELRGFWAVGRARPFRRRRSWASFQAGVEAPASGAFSLDLGPARLPRRGPKERLPCWTASTSSLALPLSKEAFKALGLQSTDPGPYK

SEQ ID NO: 788744 - protein, 142 aa, Homo sapiens
MVDEFQEITEGLAHGESGRSRRDFALLLVGSLWRSLSHWGSPEPWKAEVTRVIICSVLPGMGGTSSWESSSLVAYTGCLRALGPQALEPCLREAAKCSEQDSARCWLILHRASLWRLQRTDRPRHWSLRPVTQHCRLGVVEW

SEQ ID NO: 788745 - protein, 37 aa, Homo sapiens
EVKISNKFYNPVLISDTSFKDEFLFEGLFQFHEASMG

SEQ ID NO: 788746 - protein, 92 aa, Homo sapiens
NGDELHEHYVKHYSAGKRKGAIKTHNNGDELQEHYAEPLSKRYKRPGAVAHACNPRTLGGQSGWITRSGVRDQRGQCGETLSLLKIQKISRA

SEQ ID NO: 788747 - protein, 83 aa, Homo sapiens
IHGGSPSGACQGSERGDLDWAEHGVRRTRAERPPGASSGLAADCMWGEKRKPQDSAQGYGVEMEVEMAQQATQRRNLQGGSWV

SEQ ID NO: 788748 - protein, 107 aa, Homo sapiens
MGRSCVPSACLYGHVCHLASWPRDSPLIWEAAGSFQTDCCLMSWQGREALGGSGLAKLPDSFHPLTPTCYFVAAKRGICLSNNPTAGEMEDLGAMDQSPAVLPCFVQ

SEQ ID NO: 788749 - protein, 123 aa, Homo sapiens [sequence omitted]

SEQ ID NO: 788750 - protein, 72 aa, Homo sapiens
AKCCRGEPAEGAGRGCPARRPRVGAELSRGCWVRLVLAIGWTRAHRGLVSHCGLKKCRVGGIQSEGLEHNFM

SEQ ID NO: 788751 - protein, 142 aa, Homo sapiens
SFQALLCRAKELLCARLTELEGVATFRLMEAGERMEPGSLEPGTLPRCGWWWPQTSRRAAGSGSFFCRAGGLGEGRGNATCWRLEPVPPWLTSLWLVAARLAVVGGDVGDCSSATVVEMCWAFAVLGTCSHLLSSLESTALE

SEQ ID NO: 788752 - protein, 118 aa, Homo sapiens
TGKISSSPRNSTTSDNDQPPDYSFSKRISFLFGELMTTPILQPTEALSPEDGASTALIAVVITVVFLTLLSVVILIFFYLYKNKGSYVTYEPTEGEPSAIVQMESDLAKGSEKEEYFI

SEQ ID NO: 788753 - protein, 47 aa, Homo sapiens
SDEMVVELIEKNLETPLCKNGFLLDGFPRTVRQAEMLDDLMEKRKEK

SEQ ID NO: 788754 - protein, 278 aa, Homo sapiens
IGRKVDSHQHQKMQFKPDGVTVGTVLGLTALAATIAVVVGGDLIHIGCSKTKSKSALITFYLYVITLMKLMGAAGLAGIRIYRTDEKSLDESKNPPRKLDSDLLVGTASGSWLISWGSILAILCAEDHPHYTWYNLPYSIVVIVEKYIQNLFIFESIHREPKKLSEDIQTLRMVTVCNGNTMPLASSCLKSGGVAGDVAPWGRDMPPAANGNVCLRESCDKEEKHEESSWGGNPSPVHLPRFLQGNAKRKVLRNIAAFLFLCNTLLWIPPAFGCRPEY

SEQ ID NO: 788755 - protein, 164 aa, Homo sapiens
MLTDPDLPQEFERMSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEGSSH

SEQ ID NO: 788756 - protein, 129 aa, Homo sapiens
MLTDPDLPQEFERMSSKRPASPYGEADGEVAMVTSRQKVEEEESDGLPAFHLPLHEVDGNKVMSSFAPHNSSTSPQKAEEGGRQSGESLSSTALGTPERRKGSLADVVDTLKQRKMEELIKNEPEGSSH

SEQ ID NO: 788757 - protein, 189 aa, Homo sapiens
SQAFLFCPNVSIRGLCLVVCVCAAWLHGPHPRLWSRPGLWAQQTARLLPLVCEASVSMLKVASVFSMVASAPVIMFPFQRGERREGWWAVILWVALCPPLLRLPRGLCRRPHPLCIAGPQLQGEQESHLLAECVATQKNSGDRERRSGFGGSPALLTLPAALCPQQELPRGHPSAVHPPPTASSAPTLP

SEQ ID NO: 788758 - protein, 79 aa, Homo sapiens
LVLVFPFTEAETEAWRWRITYPESLLGLESRPVGCETEVPPALLLQGCGIPPRGVAGACWDLHPLLSATLGLAKPWRAP

SEQ ID NO: 788759 - protein, 36 aa, Homo sapiens
LNAVWLDYQKPCCFHSVALLTEAFLPPRPHPTPLKA

SEQ ID NO: 788760 - protein, 115 aa, Homo sapiens
MEAVNHYQVHHFFFMAGVQWHDHGFLQPRPPGLKESSHLSLLHSWDYRCVPPPEAIYFFFFLESWSLTVLPGLICISCPQVILLPWPSKVLGLYVLTTAPGIIFDADANLMKYKK

SEQ ID NO: 788761 - protein, 744 aa, Homo sapiens
ARAHLRVGPAAYRVPGVLVARVAGPAGPGLRAHGSRGWRRSRANSVSPWTKMTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKSSTFPRTGYDSVKLYSPTSKALTRSDDVSVCSVSSLGTELSTTLSVSNEDILDLVVTSSSSAIVTLENDDDPQFTNVTLSSIKETRGLHQQDCVHEAEEGSKLKILGPFSNFFARNLLARKQSARLDKHNDLGWKLFGKAPLRENAQKDSKRIQKEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 788762 - protein, 441 aa, Homo sapiens
IISSTRRRGRVGAGHGCLRARASKDPAYMEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMAFFRVDHGLMLTYFAAFEVFFEENLPKLFAHFKKNNLTPDIYLIDWIFTLYSKSLPLDLACRIWDVFCRDGEEFLFRTALGILKLFEDILTKMDFIHMAQFLTRLPEDLPAEELFASIATIQMQSRNKKWAQVLTALQKDSREMEKGSPSLRH

SEQ ID NO: 788763 - protein, 627 aa, Homo sapiens
ARAHLRVGPAAYRVPGVLVARVAGPAGPGLRAHGSRGWRRSRANSVSPWTKMTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKSSTFPRTGYDSVKLYSPTSKALTRSDDVSVCSVSSLGTELSTTLSVSNEDILDLVVTSSSSAIVTLENDDDPQFTNVTLSSIKETRGLHQQDCVHEAEEGSKLKILGPFSNFFARNLLARKQSARLDKHNDLGWKLFGKAPLRENAQKDSKRIQKEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHELFDICLARAKERWRSLSTGGSEVENEDAGFSAADREASLELIKLDISRTFPNLCIFQQGGPYHDMLHSILGAYTCYRPDVGYVQGMSFIAAVLILNLDTADAFIAFSNLLNKPCQMQRLGNVLEMSSLISRLSLSAAEKPASFVLHFRGSCA

SEQ ID NO: 788764 - protein, 82 aa, Homo sapiens
CRDGEEFLFRTALGILKLFEDILTKMDFIHMAQFLTRLPEDLPAEELFASIATIQMQSRNKKWAQVSGLCVLGFPQRSRQVA

SEQ ID NO: 788765 - protein, 205 aa, Homo sapiens [sequence omitted]

SEQ ID NO: 788766 - protein, 479 aa, Homo sapiens
ARAHLRVGPAAYRVPGVLVARVAGPAGPGLRAHGSRGWRRSRANSVSPWTKMTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKSSTFPRTGYDSVKLYSPTSKALTRSDDVSVCSVSSLGTELSTTLSVSNEDILDLVVTSSSSAIVTLENDDDPQFTNVTLSSIKETRGLHQQDCVHEAEEGSKLKILGPFSNFFARNLLARKQSARLDKHNDLGWKLFGKAPLRENAQKDSKRIQKEYEDKAGRPSKPPSPKQNVRKNLDFEPLSTTALILEDRPANLPAKPAEEAQKHRQQYEEMVVQAKKRELKEAQRRKKQLEERCRVEESIGNAVLTWNNEILPNWETMWCSRKVRDLWWQGIPPSVRGKVWSLAIGNELNITHGEWPA

SEQ ID NO: 788767 - protein, 108 aa, Homo sapiens
MAVISEKLGDFTSCVKAIYQDLYWVSVQQVHSPLTWEQLTQLARFWRPLCAQVQTFYFIATQVGYVFPAKNWLVSATLPGPGDPALDREAHPLPGQEITEPVSGSDEA

SEQ ID NO: 788768 - protein, 102 aa, Homo sapiens
MSMPSHFSLPNLSGVTVHPDCLILPLLNLLQFGFCPSHFVESFLETSLSERTSAVRSDSLLIFHYFQLAQDRTQPCWVTISSRPSSLPFRPAPSPTHASGHS

SEQ ID NO: 788769 - protein, 102 aa, Homo sapiens
MSPGADTCHRDDHRGPEELEVLTAWPRQGSCQPGLESCRGMCYVSCTCHLKCSSQHVKKKANLLHGPQCVQNTILSVVALSHGWWLLCGAWVMSGGQPRRDL

SEQ ID NO: 788770 - protein, 50 aa, Homo sapiens
LPAHIHVNQHVFLGAVVLFLAPCALILVSYIRIAAAILRIPSPTRRRKAC

SEQ ID NO: 788771 - protein, 37 aa, Homo sapiens
MYFTILHLHVVVNFVIIPTSKRSSSKPAPSVSEWLSL

SEQ ID NO: 788772 - protein, 78 aa, Homo sapiens
ENFRGTIRPPASKAGQEIRDRNMLWKLHSPGKTGGLCGHQIVTLRTWFLTSHKMPQGRSFRTPQDEGGSYSPVFLWSH

SEQ ID NO: 788773 - protein, 30 aa, Homo sapiens
MPFPLLGLSCVSLSSHFRYSLLQEACPDSF

SEQ ID NO: 788774 - protein, 270 aa, Homo sapiens
VSVSSASTRPQFLITVPVLTVINYRPHNMRPEDRMFHIRAVILRALSLAFLLSLRGAGAIKADHVSTYAAFVQTHRPTGEFMFEFDEDEQFYVDLDKKETVWHLEEFGRAFSFEAQGGLANIAILNNNLNTLIQRSNHTQAANDPPEVTVFPKEPVELGQPNTLICHIDRFFPPVLNVTWLCNGEPVTEGVAESLFLPRTDYSFHKFHYLTFVPSAEDVYDCRVEHWGLDQPLLKHWEAQAIQMPEQRELGFVPWALCWAWGIILGPPLL

SEQ ID NO: 788775 - protein, 282 aa, Homo sapiens
VSVSSASTRPQFLITVPVLTVINYRPHNMRPEDRMFHIRAVILRALSLAFLLSLRGAGAIKADHVSTYAAFVQTHRPTGEFMFEFDEDEQFYVDLDKKETVWHLEEFGRAFSFEAQGGLANIAILNNNLNTLIQRSNHTQAANDPPEVTVFPKEPVELGQPNTLICHIDRFFPPVLNVTWLCNGEPVTEGVAESLFLPRTDYSFHKFHYLTFVPSAEDVYDCRVEHWGLVQAGLQTGRPEAITCLRPGRGLPGPDGRSATRAHQAGGRTRQSAGREPTQADR

SEQ ID NO: 788776 - protein, 304 aa, Homo sapiens
RKSINRNSVRSRMPAKSSKMYGTLRKGSVCADPKPQQVKKIFEALKRGLKEYLCVQQAELDHLSGRHKDTRRNSRLAFYYDLDKQTRCVERHIRKMEFHISKVDELYEDYCIQCRLRDGASSMQRAFARCPPSRAARESLQELGRSLHECAEDMWLIEGALEVHLGEFHIRMKGLVGYARLCPGDHYEVLMRLGRQRWKLKGRIESDDSQTWDEEEKAFIPTLHENLDIKVTELRGLGSLAVGAVTCDIADFFTTRPQVIVVDITELGTIKLQLEVQWNPFDTESFLVSPSHTGKCSMDTGRVS

SEQ ID NO: 788777 - protein, 247 aa, Homo sapiens
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEVGHGG

SEQ ID NO: 788778 - protein, 104 aa, Homo sapiens
MPAPGEVASERPLTRKKRWLLPAIAPTLPSSPGCCHSLVRYDAACSPLTAFPAANQPRESPNQSHHSCEVSSHPPEREILSSSSSPVMMMRYSGRHPFCGNPTR

SEQ ID NO: 788779 - protein, 230 aa, Homo sapiens
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 788780 - protein, 104 aa, Homo sapiens; identical to SEQ ID NO: 788778

SEQ ID NO: 788781 - protein, 230 aa, Homo sapiens; identical to SEQ ID NO: 788779

SEQ ID NO: 788782 - protein, 255 aa, Homo sapiens
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWVSVQILQRWRLESVGICFQWPDWKSPAKHQLVKNIR

SEQ ID NO: 788783 - protein, 309 aa, Homo sapiens
MRKMQLSGNGLEEQAAQHLDELLLAHTDLKSLDLSYNQLNDQADLCMGLQGFLIFHSFGGGTGSGFVSLLMKRLSVDYGKKSKLEFAICPAPQVSMAMTEPYNSILTTYTTLEHSDCAFIVDSKATYDMSAQPGHRVSHVHQPQSSGQIVSSITASLCFDGALNVYLTEFQTNLVPYPHIHLPLATYALVISAKKAYHEQLSVAKIASARFEPANQMVKCDPHHGKYMACCMLYRGDVVLKDVSAAVATIKSKHTNQFVDWCPIGFKVGLGDVESLCHQEAGDLQNNAAPEGPHPLWRQPLFTSARLQG

SEQ ID NO: 788784 - protein, 309 aa, Homo sapiens; identical to SEQ ID NO: 788783

SEQ ID NO: 788785 - protein, 153 aa, Homo sapiens
MHLPFCVSWEIRHLLCEIPPLLKLACADTSRYELIIYVTGVTFLLLPISAIVASYTLVLFTVLRMPSNEGRKKALVTCSSHLIVVGMFYGAATFMYVLPSSFHSPKQDNIISVFYTIVTPALNPLIYSLRNKEVMRALRRVLGKYILLAHSTL

SEQ ID NO: 788786 - protein, 183 aa, Homo sapiens
MTRHLHEAFSRHHKLAASSPPLLLRPPPSSHSGTSLGHLDATLPLTSHIQPHQEILSAPTWTSSQDPATSHLPWVAPGLSHHGLLLGLLQSSPPLSHASTLAPGSPHVPCVNQVRATGETWPGIGRPGSNLCFVTSLLFDLRPVSHTLGISIKWELVGDGKLIILLTLSLPPSMASTLMQGSS

SEQ ID NO: 788787 - protein, 181 aa, Homo sapiens
MTRHLHEAFSRHHKLAASSPPLLLRPPPSSHSGTSLGHLDATLPLTSHIQPHQEILSAPTWTSSQDPATSHLPWVAPGLSHHGLLLGLLQSSPPLSHASTLAPGSPHVPCVNQVRATGETWPGIGRPGSNLCFVTSLLFDLRPVSHTLGISIKWELVGDGKLIILLTLSLPPSMADITNQL

SEQ ID NO: 788788 - protein, 136 aa, Homo sapiens
RVELLSIIDYKRISLPEDKSTPFMEPPHCSSCLGTIFSCRQVKICAGFSGLDRTVSLKLIDSDYYYYYYYYYFETESFSVAQAGVKWCNLGLLQAPPPGFTPFPCLSLLSSWDYRCPPPRPANFFCIFSRDGVSPC

SEQ ID NO: 788789 - protein, 38 aa, Homo sapiens
HCHAIGLSLLLGRKYYFELHPVLCKGCWPKDFQEHSVA

SEQ ID NO: 788790 - protein, 30 aa, Homo sapiens
MSIYRTKDAGDNHVVGATAASPCYSTPEVP

SEQ ID NO: 788791 - protein, 91 aa, Homo sapiens
SPGTDGHRPTPRDRLKILRIHEQALQLSPKPYSFLWELPAKKAAHGNLKPCCKPWPHQWCKSSPYQDLSRGNLSCKSNWRLRQLTCLRSLS

SEQ ID NO: 788792 - protein, 129 aa, Homo sapiens
VTRVPSLARVGVGGATPHGSSPPSRRDPSGGASRWATGTRGESDKLEARAACKTFGPPAATLRERPPFLRPRVGPIPVCPDPCAPGLGGAAASRLPGALQPSLSRTRRSPVRAAPPRQAGGPGGRAGAD

SEQ ID NO: 788793 - protein, 109 aa, Homo sapiens
GSVFPLPSCPTPNLLSFNPIQMPLLHMVEGECGESGCPGEYFSQPQHSGACLLRACSAQEGWPLQIREGTLLARPRDHALTARLPQLQLPDFLMWNSCSPGAMRIRAHS

SEQ ID NO: 788794 - protein, 60 aa, Homo sapiens
MQDPKAWELRYLRPQESSSFPCQKPRSQPLTSRVSRPHSPATSGSGDIMGVPSSFGIMGF

SEQ ID NO: 788795 - protein, 60 aa, Homo sapiens; identical to SEQ ID NO: 788794

SEQ ID NO: 788796 - protein, 55 aa, Homo sapiens
THSMSPWDNASITYTGLSLGAAFSSPKTGLGLGPGAQAWDPGAEMMGLVGAIRGR

SEQ ID NO: 788797 - protein, 227 aa, Homo sapiens
CTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRV

SEQ ID NO: 788798 - protein, 68 aa, Homo sapiens
FKLLTMYGDMHRYNQTTKRDLKTHRGGPSVETSRGRLENTGLEHRSWCGHSHRTLEEARNRFSPPAPE

SEQ ID NO: 788799 - protein, 75 aa, Homo sapiens
GISLASLDIILVGVVSGPQLEPSYCFGLSALVRSMLIKPERSCDLHRLSEESCRIRHEVVEPCVSGLAGKAVSAG

SEQ ID NO: 788800 - protein, 141 aa, Homo sapiens
GAGGGCSRAEGTETLLRALHSRESKPRASGLLGARGVRRAQCAVRIQDTLWVITALCVSETPSTYRLFFQERTPAGFTGSLGGPFLQPSALRSGHLACFCFTVPRSLCLGSEGVGSMFSEHLDVPGTRQVQNSTLRVVPPF

SEQ ID NO: 788801 - protein, 113 aa, Homo sapiens [sequence omitted]

SEQ ID NO: 788802 - protein, 204 aa, Homo sapiens
PGASLKHEVLKIMPVQKLTRAGQRTRFKAFVAIGDYSSHVDLGVKCSKEVVTAILGAIILAKLSIVPVRRGYWGNKIGKPHSVPCKVTDGSVLVRLIPVSRGTGIVSAPVLKKLVMMAGIDDCYTSARGCTATLGNLAKATTFDAISKTYSYLTPDLWKETVFTKSPYQEFTDHLVKTHTRVYVQRTQAPAVATTWGFYTRKVK

SEQ ID NO: 788803 - protein, 45 aa, Homo sapiens
KNQKPKRVFFTFTCTLSVETCRPDLGVLSHTLWFSPLHLLIFTLS

SEQ ID NO: 788804 - protein, 111 aa, Homo sapiens
GEHKPIHIFSTLLLQPAFEKHIKTVYNQGILIECLPLKTLRSKAKQPYSTNIIVISPKGINMAFISKSKFKNNKRKYLQMRRKQCNNSGNMKKCGCYDIPKQAHQLGSNGS

SEQ ID NO: 788805 - protein, 77 aa, Homo sapiens
GGDLRRRQLGEIQLTVRYVCLRRCLSVLINGCRNLTPCTSSGADPYVRVYLLPERKWACRKKTSVKRKTLEPLFDET

SEQ ID NO: 788806 - protein, 106 aa, Homo sapiens
SFNIMFLIINSSAKRTKLEGHGIQLGGTLISPLFTRVTSQITEMGSAQSRQGGLQYPRIVWPAVSTNCVACSIHESTASLMSAPERQWERVRRSSFCPRNSSSLTS

SEQ ID NO: 788807 - protein, 54 aa, Homo sapiens
EVMGAVCEALRQDSPGNLLSLMGVRVSLSESKERRGRGVQGNSEKSIFTIKHGI

SEQ ID NO: 788808 - protein, 128 aa, Homo sapiens
MASDRGQGAGMGWAPRGPMQPSHCRLSWPGPRLPKTQLILAVNWKGLCFLDQQEKMLLELSFPEVMGLATNRCGPRGKISSYTLSPCDASGGSGRDGERGSVPSRVTGRGGGTRIYVCDGFCTSEPHP

SEQ ID NO: 788809 - protein, 573 aa, Homo sapiens
MKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTH

SEQ ID NO: 788810 - protein, 103 aa, Homo sapiens
LDEMGHPRPATHSTAVPQGPGDGAGGGRTKPLPTLGAGGSRTTPLPTPSWRETVPVSPVLAWARRGTEAQSFGRGSRLFSHCQTHRQGHFNGPFARPGLLSSL

SEQ ID NO: 788811 - protein, 164 aa, Homo sapiens
KYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 788812 - protein, 191 aa, Homo sapiens
TGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 788813 - protein, 101 aa, Homo sapiens
GHLSFPVGLGCVPLLPQPSPLSPPGRSASLLGVNGCFPWGVEPTSPRGRAEEQGTVPMDTGRAGPALPCPFPGPVLRVAVNVFPRSSWRVLGPKRGECCAG

SEQ ID NO: 788814 - protein, 114 aa, Homo sapiens
DSDGQTWGIAVGWQDGKKVWELRQILKAEPTEPACGFVWGRVQRKEGHGRALWGKLLYCFQVENPDGKALKARVRSLAFVLGSQAPSVSEKLAQGSSGVVNGARQKEMGPGRAR

SEQ ID NO: 788815 - protein, 187 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPTQ

SEQ ID NO: 788816 - protein, 141 aa, Homo sapiens
MELESTIFRDEDKLFIWGRLWGELCSKQPPGAQGRGLPGWLGHFWVPCPWFCIIHTNHSMLLCSFTRRLGAQKGQGSPHSPVSPASPSSAQGTRQGLRVLEVGGCGQTAWKEFGLLIAFPSAHPGDVCSWENGRGIPNSHS

SEQ ID NO: 788817 - protein, 141 aa, Homo sapiens; identical to SEQ ID NO: 788816

SEQ ID NO: 788818 - protein, 184 aa, Homo sapiens
QLHDGASSLRIGVRHHNPIIQSAYGVETLIGFHQDPPLMFSEEYQKSLLEQYHLGLDQKRRKYVVGELIWNFADFMTNQSPTRVLGNKKGIFTRQRQPKSAAFLLRERYWKIANETRYPHSVAKSQCLENSLFTVSKTDTTCVSLPPRARATSTAAEQVPPGLFTADQNVSGLGFVVIYSSREH

SEQ ID NO: 788819 - protein, 87 aa, Homo sapiens
QLHDGAPSLRIGVRHHNPIIQSAYGVETLIGFHQDPPLMFSEEYQKSLLEQYHLGLDQKRRKYVVGELIWNFADFMTNQFLQAGNPR

SEQ ID NO: 788820 - protein, 81 aa, Homo sapiens
MSYTYSKQGELYSDIDNKVTKLHPELPESCERLLLEEYHTSVQIRYKYYWRVNLLEVSPGYSVSGEKHKNYLMRMTNFLSR

SEQ ID NO: 788821 - protein, 107 aa, Homo sapiens
PTVTVIIQPVKFHPVSLALPSSTLLKLSPYPMDYTNCLFYCRTGFSFVLHLLAHLGTVSAYLLHLQSANTQLTPHPRRPRDRNPIPPRPHPGASQCLFSFVQSHPKY

SEQ ID NO: 788822 - protein, 101 aa, Homo sapiens
GDGVVFSLAVLSLFSVGSAGNGVVFSLAVLSLFSVGSAGDSVVFSLASGVLSPCSVGSAGDDVVFSLANGVLCPFSVGSAGDDVVFSLAVLSLFSVGSAGN

SEQ ID NO: 788823 - protein, 47 aa, Homo sapiens
AELRTILKIRCLQGICSCSVALSTARYLQLLLVSLHQTLEHAASLEE

SEQ ID NO: 788824 - protein, 66 aa, Homo sapiens
PDSLTILRCVRLTSKRWQDFWWFTLYEVLHVLTSLTSYLWICDNQRLSPRPGPGAPSFLIYISGNV

SEQ ID NO: 788825 - protein, 190 aa, Homo sapiens
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKH

SEQ ID NO: 788826 - protein, 134 aa, Homo sapiens
MLPTSVGAFSGSSCICHPILQRVPRAWAPCKLLVQSRFPGWGPKSCHGPAHAAQAATWRPYRLPRDWGHAHPGPPEGQVVRRTQVTPADAGPLTWAGAGQLTWAGAGPQAGGAGPHLSCSNPRPTRPTLPGSTA

SEQ ID NO: 788827 - protein, 69 aa, Homo sapiens
QRHLCLKHPMKALQSPGQVLPKVGERRHTGASSPGCRCLPGGSCSPALTGDQDNISCTSAFSSTKQSQD

SEQ ID NO: 788828 - protein, 57 aa, Homo sapiens
MKRGYTVWSPWEVGECACPHRASAHKYNNSCLHVLMLSEQWRSSPAGAVSGVCLLSE

SEQ ID NO: 788829 - protein, 155 aa, Homo sapiens
MPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVSMVCAGQSL

SEQ ID NO: 788830 - protein, 148 aa, Homo sapiens
SISVAVPCGLPCLRVITCLQETFADVPEEAWPRISIGGLTRITKMGYNLVINGLKQRILKLEQQCKEKDGTISKLQTDMKTTNLEEMRIAMETYYEEVHRLQTLLASSETTGKKYDGRLQAVFCVLPSRCGSSSENVWLSRGCGIYCP

SEQ ID NO: 788831 - protein, 155 aa, Homo sapiens; identical to SEQ ID NO: 788829

SEQ ID NO: 788832 - protein, 104 aa, Homo sapiens
MPLGGRASLTPQKLWLGTAKPGSLTQALNSPLTWEHAWTGVPGGTPDCLTDTFRVKRPHLRRSASNGHVPGTPVYREKEDMYDEIIELKKRWGFTVLARLVSNS

SEQ ID NO: 788833 - protein, 269 aa, Homo sapiens
MLRCADTQVTILGRLHSQVPRNRRQGTQGHAGAARRPGGGRVVRKTWARAFIMRRRGRGEAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPGNFIHLDSGTRAAGLLRSQPKEWPPPRKPGCCR

SEQ ID NO: 788834 - protein, 1112 aa, Homo sapiens
RSAAWLPWQRGRGPAPGKAPRLRAARAARGFPDPDARASNPEGRPGSAATMFLGTGEPALDTKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQAVAPLPGDDVNSDDSDDIVIAPSLPMKNFQFRSPSLSPRCDGSAAEDIGTTTGKIIYRVEEKNDDTYLTPQHLRRVSLCFCLWKETQMPLLYSLGRASGSHPPHLQLQLGWWIFSANRHICRELAYAREPCSDTFSDSTLPPAHDLDREELLSATSADTMPPLPGDTLNNQDLLHLSPAGQADTPRCALGRCETGFPHPHSKTGLSQASEELKTPRSPNDLTPCPTRSHRPFPSPLLSPGALPSRAALPRKEFGWILSLWRPRFFKIPNYNHKSSITLASENSRVMSVPKLVAGALACVGPPGEEEERRVRRQARRSKGQHRLVVGRVASGVWDSPRHPMCAASALPSSMAGLGWAGLGWACGACGASSCRGLGGSSWGKRTVSSAHLLLVCEISPCWGVKRKSLRPGQAFRGI

SEQ ID NO: 788835 - protein, 36 aa, Homo sapiens
MSLSTLGSLLGPQQAGPPDPSCISLVTGNGEGLCRG

SEQ ID NO: 788836 - protein, 67 aa, Homo sapiens
ATVTEEWACETEFGPLKHDGIWEKASCFCRWAMEARWLRLPPVLDVNEEASGPNCSTATLQPEKDSP

SEQ ID NO: 788837 - protein, 75 aa, Homo sapiens
AAVTLISHLKKLSLRNTQDHRPSEVALLESSYSCCTSPASLDSLADSSAGATQRTQLPLPWDKPAKSKAKIPSYS

SEQ ID NO: 788838 - protein, 127 aa, Homo sapiens
APWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTV

SEQ ID NO: 788839 - protein, 155 aa, Homo sapiens
PGWRNLGGESPSLPQGSLFHSGTASSSQNGHEEGATGDREDGPGVALEGPLQEVLELLRPTDSTQPQLRELEYQVLGFRDRLKVWPPRPGRWPCFADGMMTGSRGLWGHAAWADILASPLRDLGGPCLSGPWFPHLASGDNNSPHGAQEDFKSSQ

SEQ ID NO: 788840 - protein, 60 aa, Homo sapiens
VGNGAEDIRGTEPGYGISKGRQRQHLGKHPILVPRGGPLSDSWLPGGAREVFVEIMNADG

SEQ ID NO: 788841 - protein, 163 aa, Homo sapiens
GSPKPWQLPHGVEPADAQKARTEVREPPSRLQKMYGNAWMSRQKFAARAGPSWRTSASVVQKGHVGLEPPHRVPTGTLPSGAMRKRSPFSRPQNGRSTGSLHRAPGKATDTQCQSVKGARREAVHCNVCQLTPFYIQVIGYGYWFICPVIGYASHKMRKSGLP

SEQ ID NO: 788842 - protein, 118 aa, Homo sapiens
CRAPSDATSSRHPPDASFPAALNFLQRTRPSSVLSEDLLMQRAVAKHPALLPSQMSSSPLRPGSGVVLVASGVSCSVLLTHLLVLLLLPPLPGWARAASGQEPRLYSLMFPELTQCLA

SEQ ID NO: 788843 - protein, 264 aa, Homo sapiens
RRRAGEDERRRRTESEVPERGQSAAARVCSKEQAFKHIAILTLSCQGTQAYEEVCYTKQCLVKTTRKKGKDRKKKLKYYRKPERSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQTTHRQRTLLQWNNVYMRHPIYHSDIPKQPTLTLKVILTSPLIRELEKKDGEN

SEQ ID NO: 788844 - protein, 123 aa, Homo sapiens [sequence omitted]

SEQ ID NO: 788845 - protein, 123 aa, Homo sapiens
MRGLQEKAVVRAQALLYCVWTHRVLGGHPGSRLPRDSQAGYANARMFPWSPSPLSSQSQVSAGVQTASTRKPWVCVGEASKDTSLFQGCLGTSSPAPSETLMWCGLGCSAGSSSGSSSRQRPQ

SEQ ID NO: 788846 - protein, 126 aa, Homo sapiens [sequence omitted]

SEQ ID NO: 788847 - protein, 530 aa, Homo sapiens
ARPGVRRARERAPSRRAGRSGQARGCVPPARPGPAMAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAGRRRNSVPQRPGPPASPAPDPSRDQSSAGDVLWAFRQVPLWPCAPHQDPELEALHCL

SEQ ID NO: 788848 - protein, 363 aa, Homo sapiens
ARPGVRRARERAPSRRAGRSGQARGCVPPARPGPAMAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYSLTASQLTGTSDSN

SEQ ID NO: 788849 - protein, 343 aa, Homo sapiens
LYWSGILGSAQYPGSGAAGSRFGFVAPVPGPGRSLRPPQPGAAAGGVGTLWTHPSGPRRRSASGPGSQSRRPRRPMESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLP

SEQ ID NO: 788850 - protein, 388 aa, Homo sapiens
RSGGGLQLAGWSRERYGATLGVPQRSRSLRPPQPGAAAGGVGTLWTHPSGPRRRSASGPGSQSRRPRRPMESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTVRSFGGPGTGRRGGYAGGLRQEADELTGLKGKRLQAASDLLLTSTPLFQTQLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLP

SEQ ID NO: 788851 - protein, 394 aa, Homo sapiens
LYWSGILGSAQYPGSGAAGSRFGFVAPVPGPGRSLRPPQPGAAAGGVGTLWTHPSGPRRRSASGPGSQSRRPRRPMESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTVRSFGGPGTGRRGRISWGPEAGGKMNCRTKRERLQAASDLLLTSTPLFQTQLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLP

SEQ ID NO: 788852 - protein, 78 aa, Homo sapiens [sequence omitted]

SEQ ID NO: 788853 - protein, 122 aa, Homo sapiens
MSDLWPIHHFILLISRIPYETRGENTHSRSHNKIGRPPQGATTRPHASHECTKENLRANKHSGAAHPQSLHPLTRRTQTHTTLTRPPQAICQGNHMTPLHRASRHSAPPHPTTPDTHPSHHT

SEQ ID NO: 788854 - protein, 116 aa, Homo sapiens [sequence omitted]

SEQ ID NO: 788855 - protein, 136 aa, Homo sapiens
TFPKFRSLRPRLSGTEDSGTIFGSVGPHQAPLDFRLWCHREAVTGLRARELWGAHLLLFLGVLHYLLFTPEISCLINVVQFYGCLMWEGESRTEDSVRAGDQSPPNIPAEAPFHLSSARTGFYCWQPGAPPEPRDK

SEQ ID NO: 788856 - protein, 110 aa, Homo sapiens
RNRGNEINKHGLPHITADLPLSLLSAQISKTEGNTEPLFGTISWKYQPPRLIISDHYIMEGAGICLHGNNYIYWRVTSLSCACCFRQHYHMWLIGCLIHPHGVTHSIVTD

SEQ ID NO: 788857 - protein, 50 aa, Homo sapiens
PLKETRDNMKRRADETKQSQDYQANIRHSCLLLIPYESSHPPIEVGKQEF

SEQ ID NO: 788858 - protein, 105 aa, Homo sapiens
IFQQGFDLKLLDKTEPDRAEGLQGNPPPPQRKYLLKKRIEVQKFQKPWWCCFGRGIETQREAGELPRPQSLSGSSLLISLRMYLGGAYYAPGTVQRPRQTPSVPL

SEQ ID NO: 788859 - protein, 97 aa, Homo sapiens
MFVMFVPYGTKEAFGRLSIVLRSEDETALGGLLSSGGIQLIVVECSSSHRFIVRPYTLCGARARSVFTLDSLGILSWFLIHSFCLLVGKSGSCYHPV

SEQ ID NO: 788860 - protein, 77 aa, Homo sapiens
LSHQVTPGEPTPPPHPFNSSKHQVTVPGANSSIASCSTITSALNLDPSVISRGWGRQQRRKGGSSEDSTRGGEAAAG

SEQ ID NO: 788861 - protein, 146 aa, Homo sapiens
VSQTTFATIMSVKVACHKAILIHLIVFQDSQLNLLSLVLILLGSGVRLLLPFLSTTTKSQHKMKSRLLLNIVVRQSTSIFQLLASKDQSLLIRRNSFLILDLGLYIFYRIRGFNLEGDGLPRKGFHENLHFGGGSTETGADSGRGE

SEQ ID NO: 788862 - protein, 111 aa, Homo sapiens
LVHSGVLEPLVNLLTAPDVKIVLIILDVISCILQAAEKRSEKENLCLLIEELGGIDRIEALQLHENRQIGQSALNIIEKHFGEEEDESQTLLSQVIDQDYEFIDYECLAKK

SEQ ID NO: 788863 - protein, 96 aa, Homo sapiens
MDVISIDKTGENVRLIYDTKGHSAVHHITSEEAKYKLCKVRKIFVGTKGIPHLVIHDVHTIHYPDPLIKVSNRFRLVWRLARLLILSSSTLVTCVW

SEQ ID NO: 788864 - protein, 96 aa, Homo sapiens; identical to SEQ ID NO: 788863

SEQ ID NO: 788865 - protein, 663 aa, Homo sapiens
MFLKAGRGNKVPPVRVYGPDCVVLMEPPLSKRNPPALRLADLATAQVQPLQNMTGFPALAGPPAHSQLRAAVAHLRLRDLGADPGVATTPLGPEHMAQASTLGLSPPSQAFPAHPEAPAAAARAAALVAHPGAGSYPCGGGSSGAQPSAPPPPAPPLPPTPSPPPPPPPPPPPALSGYTTTNSGGGGSSGKGHSRDFVLRRDLSATAPAAAMHGAPLGGEQRSGTGSPQHPAPPPHSAGMFISASGTYAGPDGSGGPALFPALHDTPGAPGGHPHPLNGQMRLGLAAAAAAAAAELYGRAEPPFAPRSGDAHYGAVAAAAAAALHGYGAVNLNLNLAAAAAAAAAGPGPHLQHHAPPPAPPPPPAPAQHPHQHHPHLPGAAGAFLRYMRQPIKQELICKWIDPDELAGLPPPPPPPPPPPPPPPAGGAKPCSKTFGTMHELVNHVTVEHVGGPEQSSHVCFWEDCPREGKPFKAKYKLINHIRVHTGEKPFPCPFPGCGKVFARSENLKIHKRTHTGEKPFKCEFDGCDRKFANSSDRKKHSHVHTSDKPYYCKIRGCDKSYTHPSSLRKHMKIHCKSPPPSPGPLGYSSVGTPVGAPLSPVLDPARSHSSTLSPQVTNLNEWYVCQASGAPSHLHTPSSNGTTSETEDEEIYGNPEVVRTIH

SEQ ID NO: 788866 - protein, 349 aa, Homo sapiens
MNRKARRCLGHLFLSLGMVYLRIGGFSSVVALGASIICNKIPGLAPRQRAICQSRPDAIIVIGEGSQMGLDECQFQFRNGRWNCSALGERTVFGKELKVGSREAAFTYAIIAAGVAHAITAACTQGNLSDCGCDKEKQGQYHRDEGWKWGGCSADIRYGIGFAKVFVDAREIKQNARTLMNLHNNEAGRKILEENMKLECKCHGVSGSCTTKTCWTTLPQFRELGYVLKDKYNEAVHVEPVRASRNKRPTFLKIKKPLSYRKPMDTDLVYIEKSPNYCEEDPVTGSVGTQGRACNKTAPQASGCDLMCCGRGYNTHQYARVWQCNCKFHWCCYVKCNTCSERTEMYTCK

SEQ ID NO: 788867 - protein, 349 aa, Homo sapiens; identical to SEQ ID NO: 788866

SEQ ID NO: 788868 - protein, 282 aa, Homo sapiens
MGLDECQFQFRNGRWNCSALGERTVFGKELKVGSREAAFTYAIIAAGVAHAITAACTQGNLSDCGCDKEKQGQYHRDEGWKWGGCSADIRYGIGFAKVFVDAREIKQNARTLMNLHNNEAGRKILEENMKLECKCHGVSGSCTTKTCWTTLPQFRELGYVLKDKYNEAVHVEPVRASRNKRPTFLKIKKPLSYRKPMDTDLVYIEKSPNYCEEDPVTGSVGTQGRACNKTAPQASGCDLMCCGRGYNTHQYARVWQCNCKFHWCCYVKCNTCSERTEMYTCK

SEQ ID NO: 788869 - protein, 39 aa, Homo sapiens
MSGCYSTAPSPVNPAREGPALVPTGDAASKQGDQGVPKM

SEQ ID NO: 788870 - protein, 659 aa, Homo sapiens
MAAAVLMDRVQSCVTFEDVFVYFSREEWELLEEAQRFLYRDVMLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLAQHQRVHTGERPYDCSECGKAYSRSSHLVQHQRIHTGERPYKCNECGKAFSRKDTLVQHQRFHTGERPYECSECGKFFSQSSHLIEHWRIHTGARPYECIECGKFFSHNSSLIKHRRVHTGASSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 788871 - protein, 69 aa, Homo sapiens
KSKELRYKELGGPDLSQGASWLQPPCTWQERPRRHSQLLLEVVTLKPVPTVDVNGPESPPRHPIPPGLC

SEQ ID NO: 788872 - protein, 212 aa, Homo sapiens
MEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEVIVEPIPIGQAAKDYLNLHIMPTLLEGLTELCKQKPADPLIWLADWLLKNNPNKPKLCHHPIVEEPY

SEQ ID NO: 788873 - protein, 148 aa, Homo sapiens
MEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEEKL

SEQ ID NO: 788874 - protein, 212 aa, Homo sapiens; identical to SEQ ID NO: 788872

SEQ ID NO: 788875 - protein, 194 aa, Homo sapiens
MEISMPPPQIYVEKTLAIIKPDIVDKEEEIQDIILRSGFTIVQRRKLRLSPEQCSNFYVEKYGMILARHKAISYWLELLGPNNSLVAKETHPDSLRAIYGTDDLRNALHGSNDFAAAEREIRFMFPEVIVEPIPIGQAAKDYLNLHIMPTLLEGLTELCKQKPADPLIWLADWLLKNNPNKPKLCHHPIVEEPY

SEQ ID NO: 788876 - protein, 50 aa, Homo sapiens
IVPSQEVLSVGDDILARCKGCVGVGQVKTRGEKCSGQRKEPLEGMGNPEL

SEQ ID NO: 788877 - protein, 107 aa, Homo sapiens
RQRGKGSPRLSNCMLSGVSLPFLSWDLWAHVHTYLSHLFFEMESRSVAQAGVQWHDLSSLQPPPPGFKRFSCISLPSSWDYRCAPPHPANFCIFSRDGVSPCCPGCS

SEQ ID NO: 788878 - protein, 107 aa, Homo sapiens
ERACCFCAHGCDVVCLKPWLRFHREAPTSHMRRTLDLWFALWKAGKPLWNPRELHAILFYFTDVPHLCFLQPPQQSSHSFPISFPCMAFGPFPHECSAYERGSGRDN

SEQ ID NO: 788879 - protein, 158 aa, Homo sapiens
MEYQLLDIKGNEQIEKYSWREACDTGSSRMDRKHGKYILNVEHSENQPVKEYCRNDWSMWKVFLACLLACVIMTAIGVLIICLVNNKGSANSSIVIQLSTNDGECVTVKPGTPSPACPPTMTTTSTVPASTATESTTSTATAATTSTEPITVAPTDHL

SEQ ID NO: 788880 - protein, 165 aa, Homo sapiens
SSSSSSSSSSSSSSSSSSSSSSSQAKKPDPPLPPAFGAPPPPLFDAAFPTPQWGIVDLSGHQHLFGNLKRGGPASGPGVTPGLGAPAGAPGPLPAPSQTPPGPPAAAACDPTKDDKGYFRRLKYLMERRFPCGVCQKSFKQSSHLVQHMLVHSGERPYECGVCGR

SEQ ID NO: 788881 - protein, 83 aa, Homo sapiens
RTVLLCCVAPSVAPQGGVLTAALPTDAPSSFRNQAGPTTIPLSNQLPTLTGVCLCAAFRRRLSELRFPRRSMGTGLPVPTHWW

SEQ ID NO: 788882 - protein, 195 aa, Homo sapiens
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQ

SEQ ID NO: 788883 - protein, 107 aa, Homo sapiens
MGRAGRALLSGREPRHSSELGPLNFKPSQAGEPGPWTDPGGQGPHLLDGCPGRPVSAGGLLRGDPWLLSGTGGSPLFHWCLGRNARFCHLLPTLEHVDWVLSSQYWM

SEQ ID NO: 788884 - protein, 142 aa, Homo sapiens
FKLPQADWLKKNNFGGAMVWAIDLDDFTGTFCNQGKFPLITTLKDALGLQSTSCKAPAQPIAPIAEANITCGVSHSRSSGGRSGRSSGGSPRGSGFCADRASGLYPDPTDKNASYSCVNGKTFTQHCQPGGVFDTFCSCCSW

SEQ ID NO: 788885 - protein, 103 aa, Homo sapiens
SDLGQPRKSPLTGTDKKYPLMKQRGFYSDILSPGTLDQLGEVCRGPRMSQNLLRQADLDKFTPRVGSFEVPEDFQERMEQQCIGSTTRLLAQTDFPLQAYEPK

SEQ ID NO: 788886 - protein, 123 aa, Homo sapiens
GGGWLGVKETGRGPRTQSCPASRAPGDTAGSTRGTAQTHLSPCLSPRPSFTWLGLGFFISNVRVNRTPQRTGVGQTGKCGCCIGKAGVDQGLGCMNLTTPLGLLFRGLEAKSHRGLGSRALSS

SEQ ID NO: 788887 - protein, 77 aa, Homo sapiens
TITVKWWRREETNMEILDSEDDLGKLYSVVGEAWASESGKLHGNTGVDTHFMALDKKYANLFSHLSNGDNYPCLVEL

SEQ ID NO: 788888 - protein, 45 aa, Homo sapiens
EPCGMSSAHVAAVPLSSAQGNASGQAGADTIRLTPLPGPQGQLSP

SEQ ID NO: 788889 - protein, 127 aa, Homo sapiens
DSRGSPVPPTHVPPRGAPGHPVSILANMLRKSPGICLLLASKKATLRASGDGRELERGHTDFCNSASITSVTSASPLDSAQPLGSKIAVPFHRQAMRLGPCPAGHAEDHRPPGPWPCLCGKMTLRKA

SEQ ID NO: 788890 - protein, 103 aa, Homo sapiens
GTHRRTIGGSMVWRATRGPFSGAKDIQMCSWFSLRLWRARGKEATEQTFFFFFFFFFFETEFCSCRPGWSAMMRSLLTATSASQVQAILLPQLGLQACTTTPG

SEQ ID NO: 788891 - protein, 526 aa, Homo sapiens
MLQEESDLSLIIAQIVQKLKGSNLYSQLERQAWASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 788892 - protein, 495 aa, Homo sapiens
MKASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 788893 - protein, 242 aa, Homo sapiens
MLQEESDLSLIIAQIVQKLKGSNLYSQLERQAWASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKRMPLWELGLKIIRDKLGYNEFLHKVALLNFFEKLNVTFGAKKRF

SEQ ID NO: 788894 - protein, 461 aa, Homo sapiens
MLQEESDLSLIIAQIVQKLKGSNLYSQLERQAWGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 788895 - protein, 381 aa, Homo sapiens
MVPAAMYGSPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 788896 - protein, 433 aa, Homo sapiens [sequence omitted]

SEQ ID NO: 788897 - protein, 85 aa, Homo sapiens
ELSEEERSLGSCLCPPPLFLNLGEAESPCQLQGGKETPSLEMDRGFREAAWGRPAGSGPGVGTQAPCSYTSEQSRVPSSTIGIIA

SEQ ID NO: 788898 - protein, 317 aa, Homo sapiens
RVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 788899 - protein, 127 aa, Homo sapiens
RVGSGEFGVEMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNSSPL

SEQ ID NO: 788900 - protein, 114 aa, Homo sapiens
MAVRGSIEQETMRPKFKSQSFLTPKSSFFPVILLKCRFQMKTDLILNITYKKKGTTGYTQSMVPASASGEGLRKLTIILEGEEEASASHGKRGSKREGDSAAHFKKKPYLTRQN

SEQ ID NO: 788901 - protein, 501 aa, Homo sapiens
MNCRSERERLQAASDLLLTSSPLSQPQLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAEGFENQMRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788902 - protein, 514 aa, Homo sapiens
PVIRLSTPDPALPGLGSGSLPRCRDRAGLSGRPSRAQHPELPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWPQSMHRLSGFENQMRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788903 - protein, 541 aa, Homo sapiens
PVIRLSTPDPALPGLGSGSLPRCRDRAGLSGRPSRAQHPELPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKGKQGCRLQPPGATRELIGMQFLWAGWWVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWPQSMHRLSGFENQMRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788904 - protein, 192 aa, Homo sapiens
MRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788905 - protein, 309 aa, Homo sapiens
MNCRSERERLQAASDLLLTSSPLSQPQLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAGRSAAR

SEQ ID NO: 788906 - protein, 457 aa, Homo sapiens
HGPGPATSGGATTLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAAGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788907 - protein, 487 aa, Homo sapiens
HGPGPATSGGATTLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAEGFENQMRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788908 - protein, 548 aa, Homo sapiens
PVIRLSTPDPALPGLGSGSLPRCRDRAGLSGRPSRAQHPELPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVWGGPGRGEAVKWWGWLQGLSSGMGRPCLVLFSELSHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWPQSMHRLSGFENQMRLCWRRPCGNEERCSVCWSLFLPPGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 788909 - protein, 309 aa, Homo sapiens; identical to SEQ ID NO: 788905

SEQ ID NO: 788910 - protein, 70 aa, Homo sapiens
AHKYFVHVLNTRTTNTISLRHRTSRTKLRGSRQVFDCLGFMPQAKDIPAESSDIDHMTPLHSAAYILTLP

SEQ ID NO: 788911 - protein, 114 aa, Homo sapiens
GDAGQSLPKVPSLSFLICNTGWYVTTLSGYCDSPIHEAVVGPGSTLGTFQMASEIWQRPLLAEAKCGSQEPHRSGSQTSQDAIPALPNSQPDLSQAFPFPGPPPSLLENGHSGP

SEQ ID NO: 788912 - protein, 114 aa, Homo sapiens
IPPRPRRPTRVPKGRCERRGRRPRRVLPSRTCRRPNLGTVGRRRQGPLPGRRRSRHLHGERYLLLRAHHVPQRGVEKRGSEKRRGPPGRAARRARPGHAGLPPTRPLRRRRERP

SEQ ID NO: 788913 - protein, 143 aa, Homo sapiens
KSKAGQPPTQERHRARGASPTQGSGAGKSEVTGDQSRPLVYWSSHGKVARLFLTWVSTPISPHWASPPGLGFQPPFTGTLEPVAALQQPGTELPLGGWCFHLFCLAALTFAVSRLWRVHGTEAWSEPQAQYPSHQKVVRRFSM

SEQ ID NO: 788914 - protein, 170 aa, Homo sapiens
MLGGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPSPESTPTLQQKRKPSRGSREWERNQNLINACTEGHAPHGGPL

SEQ ID NO: 788915 - protein, 69 aa, Homo sapiens
EFDKIQHHFMISKTFNKLGIEGNFLNLMKGICEKSTANIMLSGEILDSFLLSSGTRQQFLLLPHLVTLY

SEQ ID NO: 788916 - protein, 121 aa, Homo sapiens
RLGMARLWSLLIQQASLACILRVPKTEQKKGFLRPKPRTDPESGFQSWFTSYMALGKKPLHASDSSFVKRRLSELTCVERAQSCAKHLISAIRMFVTISELIRKMIWSMFLIVLKCTGLVI

SEQ ID NO: 788917 - protein, 97 aa, Homo sapiens
REKLAVARLQREVAQRTSEGAMHEKLIHEPGRGETLTVFKAEKRLQEVTRESLNATEFRCVLQQQFSRMEETVRNLLQSQGSPEQKKEETVNIMVYQ

SEQ ID NO: 788918 - protein, 106 aa, Homo sapiens
NVIQDVINIKLDCIILHAKFSKSSFVSHLQHISLKLATSLPSRRKTVTRQGWQGRGGGRQGPSRSAHPALWSQQVSSSWQEACPRLAGDSVRCSLWTGKGVWKGHT

SEQ ID NO: 788919 - protein, 113 aa, Homo sapiens
RALYAFPRPCRVWVVSVGAQDSQLKTAKSGIIMIIFIIIICIRQMTQPVSERARTGSQGIGFPSSPVRGQIWSSGKRRQGAGLAPCQASAPCQASAPCISASASAVLGEVGGT

SEQ ID NO: 788920 - protein, 92 aa, Homo sapiens
SHGMKVAELKEKIDRRFGKKLEDGFTFLKSGDAVIVDMVPGKPMCVESFLDYPPLGRFAVRDMRQIVAVGVIKAVDKKAAGAGKVIKFAQKA

SEQ ID NO: 788921 - protein, 69 aa, Homo sapiens
TWGRSGVCCLGDPACDLAVAGRSWRGGGCLPALMTGPAVTALSEGFSCVNLLDSREATRPSCVLCQGPE

SEQ ID NO: 788922 - protein, 117 aa, Homo sapiens
MRLCQPFPHHPCPATIIFTAHKAPLPHCHPHNRQAWLWTGSLLSLELPGCLQPPVQDQICNATAAPWPSCRPCTFRHLLASGPKSPTALIPLPSYPLSRAAVSICLPFLSYPLPPLQ

SEQ ID NO: 788923 - protein, 137 aa, Homo sapiens
LGGEQGYSSASVTRQSPVRSGMDNARTLGWEGLLLTGRERRRRYGDDSQGRALPTLMGLLGCASETGGQCHSHQCSYCQESLAVAGWPSCSTFFPCSSKHFLSQHQLYLLLLLTTHSSDSARFHRKRSYFGRLDGVR

SEQ ID NO: 788924 - protein, 105 aa, Homo sapiens
PPPRPPCTTLPRALSADHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 788925 - protein, 140 aa, Homo sapiens
RVDKRTLVELHGFQAPAAQGAFLRGSGLSLASGRFTAPVSGIFQFSASLHVDHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 788926 - protein, 67 aa, Homo sapiens
LLPCGAVFRCLEAVSGLESNSRVFTLQVQGLLQLQAGQYASVFVDNGSGAVLTIQAGSSFSGLLLGT

SEQ ID NO: 788927 - protein, 133 aa, Homo sapiens
NLMNVMFVGKPLAIVNPLLCIREFIQERNLMSVRNVAKPSARLPILLYIREFILEKGPMSVKNVEKPSGRVYILLIISEFIPESHQLFSPLPSHTTKSYRFNLVNASSIHLLFSSTCPIIIVQDATISSGFLQ

SEQ ID NO: 788928 - protein, 101 aa, Homo sapiens
SWRSFHINELVCLLDDLHQCCQGYMSVTSSFLEAKGEYGLNFFCHFSVRLLITNRNRHKEVMPPAAPLKQEVGKKRAIHSVLCLLPNSIWLRFVLPFFSCK

SEQ ID NO: 788929 - protein, 44 aa, Homo sapiens
QSFPRKLHDLALGYSEMLVKFWQPELFLLQAEIREIPFLLLAIL

SEQ ID NO: 788930 - protein, 191 aa, Homo sapiens
ASECISKDDSAFKEIPDLKTIIIKGTTPNNSLYIQNNSLSDFQNIPVQDSLGSSNNPLYLTSSLENMTVDNLNASKETEVGNVSLVEQSAKNHTFKNDNLQFSQCESPSLTELFQEHKENNISQCFTLSDLCNQSSASFTDLSLGSFPLSQLANRCQSSPGISELTGSLSSLAFHKASPTRDLENLSLSEL

SEQ ID NO: 788931 - protein, 311 aa, Homo sapiens
MDLKLKDCEFWYSLHGQVPGLLDWDMRNELFLPCTTDQCSLAEQILAKYRVGVMKPPEMPQKRRPSPDGDGPPCEPNLWMWVDPNILCPLGSQEAPKPSGKEDLTNISPFPQPPQKDEGSNCSEDKVVESLPSSSSEQSPLQKQGIHSPSDFELTEEEAEEPDDNSLQSPEMKCYQSQKLWQINNQEKSWQRPPLNCSHLIALALRNNPHCGLSVQEIYNFTRQHFPFFWTAPDGWKSTIHYNLCFLDSFEKVPDSLKDEDNARPRSCLWKLTKEGHRRFWEETRVLAFAQRERIQECMSQPELLTSLFDL

SEQ ID NO: 788932 - protein, 157 aa, Homo sapiens
MKQRLMISISISICVSISISISISICVSISISISISICVSISISISICVSISISISISICVSISISISICVSISISISISICVSISISISICVSISISISISICVSISISISISISICVSISISISICVSISISICVSISISISICVSISISICVSI

SEQ ID NO: 788933 - protein, 93 aa, Homo sapiens
YVQARLIHPKLRPRGNPWGLSFAPSLRGEVPWAEAGRFWKRAEGRLGMNPGIPGTGVWSTRGVGSRTPRYMGEERVWKIALGGVGQGVGARVP

SEQ ID NO: 788934 - protein, 119 aa, Homo sapiens
CVSTLGVLQCTDWQTAWLLSRALTVMHLCVFRAMVTASLSLPQASVFLQASALRLSCQAWLLSSPWLSGVKAHLVLLVWFTCVKSKTLHAYSHISQKTPACCFSERGSQCEPCGRSFLV

SEQ ID NO: 788935 - protein, 67 aa, Homo sapiens
NNKESQNCLENTLSVLIPSHSLFHSPASELFLYSFNRLQCFFFSLQTFFIANYPGCLLRLSFLDFYY

SEQ ID NO: 788936 - protein, 204 aa, Homo sapiens
MCRSPKVFPLSLCSTQPDGNVVIACLVQGFFPQEPLSVTWSESGQGVTARNFPPSQDASGDLYTTSSQLTLPATQCLAGKSVTCHVKHYTNPSQDDDCALPSSLNSTYPISLNSTYPTHVPLPTHVPLPTHVPLPKNKVCLLDVQPHTVKHLRTLEFKPYVIFIKPPSIERLRETRKNAKIISSRDDQGAAKPFTKERIFKKMD

SEQ ID NO: 788937 - protein, 126 aa, Homo sapiens
TQRRRRRERQQPGPRGTPARHGQQERQARARGHSLPPGHCERLCAPQRGVRTRGQRGHGRDKGQQTPGLGGCAQGPARGILPVPTPLPGRPEREERAPSYSGDAAGERAFCLLRCATAAGAWGGPC

SEQ ID NO: 788938 - protein, 311 aa, Homo sapiens
MLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQGEQILGHYSQTSRRLKIP

SEQ ID NO: 788939 - protein, 378 aa, Homo sapiens
MLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQVWFQNARAKFRRNLLRQENGGVDKADGTSLPAPPSADSGALTPPGTATTLTDLTNPTITVVTSVTSNMDSHESGSPSQTTLTNLF

SEQ ID NO: 788940 - protein, 469 aa, Homo sapiens
KQPGNAENSTSFSFFVFKTIFFLHQILFSSPRCSCFPLVTRSLRAVRFAFYASFSLRPNCLFSAHLLQGAAEASPQLFPVLFASPRPPKQTDFHSICFFSSFLSLFPSILERLCAPTGQPSLVPCLLHSDELKAPGVCIMEIVGCRAEDNSCPFRPPAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQGEQILGHYSQTSRRLKIP

SEQ ID NO: 788941 - protein, 157 aa, Homo sapiens
PHVLYPQGSPNPPEIPGGVRAGLSFLLCLSAVSGSQARCLRCAKESFQLNSETPGAWGFGQETSAPRLGGHLHTLIPKPPSRTGIQTKIAKRNNKTKCKVLRESAAESVPGHGYCFAALTGTLGRSASLSFPQPIPCAESVLTLTTRLCYTPTAQWL

SEQ ID NO: 788942 - protein, 123 aa, Homo sapiens
INTTSPPAKGSAPQSQVPCDGDHCVPFPETFHGSVHLQVLPHCQVGPQRILLRAVPQEAQGFPSTAPFQNHLCKISSFLDSIPNVTYMYMHVSRTSEMPFSSHTQVLSAQMQISNHLTLGKRW

SEQ ID NO: 788943 - protein, 69 aa, Homo sapiens
IPLSMNVSTFLAYDQPTISYCGVHHELLSHKSFETNAQEDTMETHLETELDLSTITTAGRISDHKQQLA

SEQ ID NO: 788944 - protein, 83 aa, Homo sapiens
QSYLTLFIQKHNPLSEIMVKTKVTFQLFDRAPPPRPFNSRGLTGREKVPPTAPPPASTAGTGQDIVGPMKVIFLSLFVFPLPE

SEQ ID NO: 788945 - protein, 89 aa, Homo sapiens
TFSSFHDFALHLLLAAGRAKGPCIALTFKGSGFPVRDVQAPYLGMHSLVGSSASSPAQPQPCQPRRAAPCSSKASPGPCTFATLHLWCI

SEQ ID NO: 788946 - protein, 64 aa, Homo sapiens
MNIVHTRRVFSPCPFPYTSLLLEPPVSIVLIFMFLCTQGLAPLISENMQYLFFFFNTSRLLIEM

SEQ ID NO: 788947 - protein, 112 aa, Homo sapiens
SLLPRWGHRASWRLIRDGTCGGFPCCQQEWALDSSRCFKIKRKGAIMQPNRRRGSCLQNEAFSVIGPQPQSTVRPPHRPPQGCSRDASVIGCFAVPALGLFKLQDFQFQLRL

SEQ ID NO: 788948 - protein, 446 aa, Homo sapiens
CVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSTPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVMYAQLDHCVFIQRKISRPSQRPKTPLTDTSVYTELPNAEPRSKVVSCPRAPQSGLEGVF

SEQ ID NO: 788949 - protein, 84 aa, Homo sapiens
KRAGEEATIKLSWPILFEDSFLFWLRIKPRSCRRGKESGRFLGRRESPKNCLDRRSRGTHDLQPARPGGSKRPPSSFLSQLGWE

SEQ ID NO: 788950 - protein, 409 aa, Homo sapiens
RCSSQDSILDTQQSIPMVKRPHNCNSHGEDATQNSELIKTQRMFVGKKIYECNQCSKTFSQSSSLLKHQRIHTGEKPYKCNVCGKHFIERSSLTVHQRIHTGEKPYKCNECGKAFSQSMNLTVHQRTHTGEKPYQCKECGKAFHKNSSLIQHERIHTGEKPYKCNECGKAFTQSMNLTVHQRTHTGEKPYECNECGKAFSQSMHLIVHQRSHTGEKPYECSQCGKAFSKSSTLTLHQRNHTGEKPYKCNKCGKSFSQSTYLIEHQRLHSGVKPFECNECGKAFSKNSSLTQHRRIHTGEKPYECMVCGKHFTGRSSLTVHQVIHTGEKPYECNECGKAFSQSAYLIEHQRIHTGEKPYECDQCGKAFIKNSSLTVHQRTHTGEKPYQCNECGKAFSRSTNLTRHQRTHT

SEQ ID NO: 788951 - protein, 409 aa, Homo sapiens; identical to SEQ ID NO: 788950

SEQ ID NO: 788952 - protein, 103 aa, Homo sapiens
MVENRYTDGSVEPSGTKKEDLNDKKKKNEDETPAPVYRAKSILETWVWVKQPDTRETEAGESLEPGMQRLQLAEIAPLHSSLGDENETVSHKTNITVMCFFKT

SEQ ID NO: 788953 - protein, 108 aa, Homo sapiens
MVENRYTDGSVEPSGTKKEDLNDKKKKNEDETPAPVYRAKSILETWVWVKQPGNLSFGTLESLIYAPFLNNLDGLFVFFGNNFKKCNLKNLNIVVKYTYRKTCHFKKK

SEQ ID NO: 788954 - protein, 106 aa, Homo sapiens
YCTDWHTHVCTHTRALFPIHDQTHTHLLTHTWSPPHTFFLSLSCASTHTLAFSLTPSANMPLSGPRLKCLVCSVSNLIVRVSSYSTCFKHQVAILFLTHQAVGLSC

SEQ ID NO: 788955 - protein, 104 aa, Homo sapiens
LEGVFNQDLVVHKLSGLSALTYRDLKRHKIPRTATRDGGAPPPRPCAAVCAWVRVRVPPPWRRRACACRFQVLDLYSTRSLGAGGSVHAFLPGPGATPRRRYVH

SEQ ID NO: 788956 - protein, 103 aa, Homo sapiens
MESMKLQKCDESLSIYTEVSLFPLCMWMDMHACAQTHTHTHTHTPYFSYSILRRASYIEPLPFPLNISTLLTVRIPAHPSRLISEYHLTKKAFPDSCLGRTCT

SEQ ID NO: 788957 - protein, 261 aa, Homo sapiens
MQLVILRVTIFLPWCFAVPVPPAADHKGWDFVEGYFHQFFLTKKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 788958 - protein, 117 aa, Homo sapiens
HILLLASLIPGRKPEMPKGKKAKGKKVAPAAAVAKKQEARKVVNPVLEKRPKNLGIGQHTQPKRDLTLLCQMAPLYQVAEAKSDPLNMAESASCNEPVHPGLGPPKSYSTVIHKLAH

SEQ ID NO: 788959 - protein, 190 aa, Homo sapiens
SYSPSCLTHPREEARVILPKPLHLQKLVKKIENWLFFTSVLYRKDSPDRVSLLSPRLECNGVISAHCNLRLSGSRESPASASGELGLQMPKGKKAKGKKVAPAAAVAKKQEARKVVNPVLEKRPKNLGIGQHTQPKRDLTLLCQMAPLYQVAEAKSDPLNMAESASCNEPVHPGLGPPKSYSTVIHKLAH

SEQ ID NO: 788960 - protein, 521 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLREPARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKMTWMDS

SEQ ID NO: 788961 - protein, 137 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSNCLNSSHSATPLGSLSATLPCSSTSASPSC

SEQ ID NO: 788962 - protein, 646 aa, Homo sapiens [sequence omitted]

SEQ ID NO: 788963 - protein, 646 aa, Homo sapiens [sequence omitted]

SEQ ID NO: 788964 - protein, 411 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLREPARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQGEV

SEQ ID NO: 788965 - protein, 454 aa, Homo sapiens
MELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQIVASSQASVEEDFGRGPWLTMKSTLGLDERDPSCFLCTYSIVMVLRKAALKQLPRNKVPNMAVMIKSLTRSTMDASVVFKDPTGEMQGTVHRLLLETCQNELKPGSVLLLKQIGVFSPSLRNHYLNVTPNNLVHIYSPDSGDGSFLKPSQPFPKDSGSFQHDVAAKPEEGFRTAQNLEAEASPEEELPEADDLDGLLSELPEDFFCGTSS

SEQ ID NO: 788966 - protein, 599 aa, Homo sapiens [sequence omitted]

SEQ ID NO: 788967 - protein, 501 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLREPARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPVQALQPLQAARGTIQSSPQNRFPCQPFQSPSSWLSGKAHLPRPRTPNSSCSTPSRTSSGLFPRIPLQPQAPVSSIGSPVGTPKGPQGALQTPIVTNHLVQLVTAASRTPQQPTHPSTRAKTRRFPGPAGILPHQQSGRSLEDIMVSAPQTPTHGALAKFQTEIVASSQASVEEDFGRGPWLTMKSTLGLDERDPSCFLCTYSIVMVLRKVRILGAETQRKDHFSPSL

SEQ ID NO: 788968 - protein, 279 aa, Homo sapiens
MACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSSSWIGNQRRVTVTEVLREPARPQSSALHPLLTFESQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPVPTALTVPTQQLHWEVCPQRSPGQLRR

SEQ ID NO: 788969 - protein, 70 aa, Homo sapiens
ESGGSLLWCLLLMGLEEKVILHNFSKKDEFSDGSKMAIFAPISSALRDLLKISPVKTFLLSYNLAAGAPG

SEQ ID NO: 788970 - protein, 627 aa, Homo sapiens
MIVFGGEDRSDLFLPDSQTNEERKQYDSVAFEDVAVNFTQEEWALLGPSQKSLYRDVMWETIRNLDCIGMKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 788971 - protein, 616 aa, Homo sapiens
SPGRSVAGTVTLSPMLAAGNLGENTGHRGSREMDSVAFEDVAVNFTQEEWALLGPSQKSLYRDVMWETIRNLDCIGMKWEDTNIEDQHRNPRRSLRCHIIERFSESRQPDSTVNEKPPGVDPCKFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 788972 - protein, 120 aa, Homo sapiens
EHAYEYVCACAQMHVHTTPNQPTSSLSKKVLKPCGRDRKEPYTGELVKCNPEKLGLAPLPSSAQLVEGKNQGAGCQAKAPGREVSWPETIRPSLLSVRVTCDGYHHQCLHPEAPALTKPY

SEQ ID NO: 788973 - protein, 89 aa, Homo sapiens
AILEARFVNIAERSPVDVSKIPLPRFKLKCIFCKKRRKRTAGCCVQCSHGRCPTAFHVSCAQAAGVMMQPDDWPFVVFITCFRHKIPNL

SEQ ID NO: 788974 - protein, 142 aa, Homo sapiens
RPLIPAPRVSLGPLCSSQPSTPYPSLGNQLPRCLAQAWAMTDGWAPGAARRAERVPSRRLRWVAAAAPGVCSARGRSERTAPSEQVPAARRAHTLASPQRPKVTTVPGGFALLEKCILTVEFRRRESVNSPYHVDSPVWSRI

SEQ ID NO: 788975 - protein, 84 aa, Homo sapiens
MGKDFMTTTPKAMARKAKIDKWDLSKLKSFCTAKETTIRVNRQPTEWEKIFAIYPSDKGLISRTYKELKQIYKKKSNNPIKKWA

SEQ ID NO: 788976 - protein, 76 aa, Homo sapiens
CSYSEDQGRCFHSSHTYLFFCGSPTWCGASAGPATAPPSSRCFLGFSDCWVRSVFSSTTKGTLFLQDTHTIKADEG

SEQ ID NO: 788977 - protein, 67 aa, Homo sapiens
ESIESIQHGMEGWERGHSYNLETGGLSSPEASADPACLALCCDLCLTMLAALELTGSRPAQLGHKTV

SEQ ID NO: 788978 - protein, 81 aa, Homo sapiens
LNGANLAFHQQTSAEGPLRAGSKPSAARTRETPARQLPVWAPRPAQEPDVGHEHLRHKAQVKWMLNILQKQGQCTRVSWPN

SEQ ID NO: 788979 - protein, 80 aa, Homo sapiens
VSLGSGDGWRAGTVPPGAVVRVFLNLHQGGARESTVSWRLLHGAVWNPQYWVSDYMCYPQFFLSCQGERGSGPGRAGYRA

SEQ ID NO: 788980 - protein, 122 aa, Homo sapiens
MFSATCSRVLAPHGPPHSPDREGTGQFRPRGRQTRGEIRTQEPSPGCAILCMGRYDLTAPSSATGYAHAEPRLCTRVSSCTPRAVQGHFVTQGKGGGHICKRARCGQARIAPRELELSCSPK

SEQ ID NO: 788981 - protein, 202 aa, Homo sapiens
MRGHPSLLLLYMALTTCLDTSPSEETDQEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 788982 - protein, 135 aa, Homo sapiens
MSLGPEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQERAHSLLSPLTFW

SEQ ID NO: 788983 - protein, 202 aa, Homo sapiens; identical to SEQ ID NO: 788981

SEQ ID NO: 788984 - protein, 156 aa, Homo sapiens
VTRITPHPGNEVRYHQWEESLEKPQQVCWQRRLQGLQAYSSAGELSSTLDLANTLQKLVPSYTGGSLLEDLASGLEHSCPMPHLACSSDAVEIIPAEGVGISQLLCKQFLVTEEDIRKQEGKVKTVRERLAIALIADGLANEAEKVRDQEGCPEKR

SEQ ID NO: 788985 - protein, 121 aa, Homo sapiens
DSCFLHFLTVSPPHPIPSVLSALTPVIFGPDFLTAFCFPYFHSCLWLMTCFCSACELRMAFTFLKIVKKQKNKKTHKDYVRDSTCHPQTLKYRLFGPLRKKLSNSCFKYAKYLSINTPFGH

SEQ ID NO: 788986 - protein, 88 aa, Homo sapiens
RLAAHSLSLLTRLASPAFEDLERTIVWTRWAGGNLAAGHPEETEKPLVNRAPFLEPKQNFPKPERKRPVSPESPGAARDPGTECGLGL

SEQ ID NO: 788987 - protein, 32 aa, Homo sapiens
HLVKEEIQTANQYMKKCSLHSSLGDRARLCLK

SEQ ID NO: 788988 - protein, 118 aa, Homo sapiens
MSHVSGQLTPAHCREDKNSPLPHIEFIAFNDKMLWMLLIGLLQFYIYPNFLRLTQEQSKKRLPPPEKCANRAPLFSGHIPCSSQKSFLICISFLPPLFLLNLTEHETRENTYKYNYEN

SEQ ID NO: 788989 - protein, 75 aa, Homo sapiens
MVPLGYGIRKLQIQSVVEDHRVGTDLLEEEITKSSRSTCRVSISQLSHNDLKPECVYVRAVREALPPIKDWTPVS

SEQ ID NO: 788990 - protein, 118 aa, Homo sapiens
MPDQHRAPARWPLWLHTSLRNSSLHCSFPQAHGISPHHFASTWSHGQVLLSLPFQRAGVQFICSPPLHTTIADGALAGIQPGSPIPTSILPFWALPPALKSFRNEASQLNPPYSTIKP

SEQ ID NO: 788991 - protein, 153 aa, Homo sapiens
GASQDLPGGYCPLNQYLQGPYVDTHGLPLSTPQSCVRHVVLTGRLCRGLKAEAGTRAWRSQAPGHDGPSSSPSQPHLGLRPCSQGSLALSLVLTRFWKCGARVAGAAPDGKAPPTPQSRLGREHATVFSESYQPRARAPCTPEQHSWWEHRLM

SEQ ID NO: 788992 - protein, 67 aa, Homo sapiens
RYSHTVTQAKAKSPAVQRQEKVPQTKLNLSLLERVKGTPVYGEIRWGQRAIRYQAKQENLYLNSGTL

SEQ ID NO: 788993 - protein, 126 aa, Homo sapiens
TLPLETLVSPHEESTSLCPEEQLVIERLQGEKEQKEDSELSTGLMDSEMTPTIEGCVKDVSYQGGKSIKLSSETESSFSLSADISKADVSSSPTPSSDLPSHDMLRNYPSALSSSAGNIMPTTYIS

SEQ ID NO: 788994 - protein, 141 aa, Homo sapiens
ESDEEEGREELHFPESGLKEGTSHLRSRRTFLGVPETMSLRCLRGSQGKMSRGRLQGSGPEPSRLEPSMYRKEQELSQRCDEQERVQRLGEMALPRREEDQMLPRDQADNPWKVSVEFHSPAVPRVSRRYRMGVVAQTCNP

SEQ ID NO: 788995 - protein, 113 aa, Homo sapiens
PHCASTPRLGFFCFIQAPAPRYSGETRPGPRKKPSSSEGRTSDSTDPGIPREWDHQAAGGINPAAEALGEDEGGERGGDRVTQQPGGLCRQAPLAPFGPTRAGVPVPPSLPRT

SEQ ID NO: 788996 - protein, 77 aa, Homo sapiens
MGECALQATTVGPDQGTCLLSSIHTRSQFDSAQCLCPIAPVISQVEPGLNLLRPKSPLIGGREWVALPLQALWIIKK

SEQ ID NO: 788997 - protein, 311 aa, Homo sapiens
MSLPGTHLQRAQPIRWSHWILEHAVALTRDSERLLEVRKRINVLPLGSGAIAGNPLGVDRELLRAVLNFGAFTLYSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 788998 - protein, 291 aa, Homo sapiens
MSLPGTHLQRAQPIRWSHWILEHAVALTRDSERLLEVRKRINVLPLGSGAIAGNPLGVDRELLRAVLNFGAFTLYSMDATSERDFVAEFLFWASLCMTHLSRMAEDLILYCTKEFSFVQLSDAYSTGSSLMPQKKNPDSLELIRSKAGRVFGREDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 788999 - protein, 343 aa, Homo sapiens
APTPPRPQGAPRARRERRQRGRQAAGEEAMGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 789000 - protein, 227 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGSSGRHHKQLYVQPPLPQVQFPQGHLWRHGLCWQCPRREGCLLR

SEQ ID NO: 789001 - protein, 127 aa, Homo sapiens
APTPPRPQGAPRARRERRQRGRQAAGEEAMGARGALLLALLLARAGLRKPESQEAAPLSGPCGRRVITSRIVGGEDAELGRWPWQGSLRLWDSHVCGVSLLSHRWALTAAHCFETPTTPVTSYRISI

SEQ ID NO: 789002 - protein, 267 aa, Homo sapiens
HTREGTLGGQKRAFPDGVEGEKGRGRAWGAASRGSAVPLTIRGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFVSVLATTPSPGKHPVSLCLI

SEQ ID NO: 789003 - protein, 343 aa, Homo sapiens
APTPPRPQGAPRARRERRQRGRQAAGEEAMGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGCCLSPSHYRPHSTAISPHPPGSSGRHHKQLYVQPPLPQVQFPQGHLWRHGLCWQCPRREGCLLRECPCHHSQPRKASCVPVPYLTLMPTPGGGDCCPTLQMQKRRLGCCQGEEEDVHPVYPAPRALASWK

SEQ ID NO: 789004 - protein, 300 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 789005 - protein, 336 aa, Homo sapiens
APTPPRPQGAPRARRERRQRGRQAAGEEAMGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGCCLSPSHYRPHSTAISPHPPGSSGRHHKQLYVQPPLPQVQFPQGHLWRHGLCWQCPRREGCLLRECPCHHSQPRKASCVPVPYLTLMPTPGGGDCCPTLQMQKRRLGCCQGEEEDVHPVYPAP

SEQ ID NO: 789006 - protein, 187 aa, Homo sapiens
MLVKNNHLSDKIIVLPGKTEDVSLPEAVDVIISEPMGYMLFNERMLESYLHSKKWLKSNGMMFPTFSDIHLAPFSDEQLYVEHFSRANFWYQQCFYGVNLSSLQGATVDEYFRQPIVDTFDVRILMAGTVKYTVNFMDAEEEDLHRWQSGLIHGLAFWFDVAFVGSLYVYPPPTFSQSALPHAIYYL

SEQ ID NO: 789007 - protein, 84 aa, Homo sapiens
PQPSSNPKPRPCPPCFDSVPFLSPAAEAALLPQNDTRLDPEAYGAPCARGSQPWQVSLFNGLSFHCAGVLVDQSWVLRFGRVPS

SEQ ID NO: 789008 - protein, 276 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVPGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 789009 - protein, 122 aa, Homo sapiens
VEGGRGLKVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRLQLIQMLCSC

SEQ ID NO: 789010 - protein, 75 aa, Homo sapiens
RLCLNLAEERQTTGRAEARLGPLPPSYRRLPDPGHESSAPPPLRRLWRPGSGEAAAAADGATLGLQMCWLLLPQN

SEQ ID NO: 789011 - protein, 276 aa, Homo sapiens; identical to SEQ ID NO: 789008

SEQ ID NO: 789012 - protein, 146 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARP

SEQ ID NO: 789013 - protein, 284 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVPGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRLQLIQMLCSC

SEQ ID NO: 789014 - protein, 276 aa, Homo sapiens; identical to SEQ ID NO: 789008

SEQ ID NO: 789015 - protein, 276 aa, Homo sapiens; identical to SEQ ID NO: 789008

SEQ ID NO: 789016 - protein, 683 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 789017 - protein, 596 aa, Homo sapiens
RPRGPTPARVGAPRGAPLRAAPGTARGSGFPPAQVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 789018 - protein, 508 aa, Homo sapiens
RIVITGHRWLLCQVVNRQSIREIVIISDKVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 789019 - protein, 184 aa, Homo sapiens
MCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 789020 - protein, 683 aa, Homo sapiens; identical to SEQ ID NO: 789016

SEQ ID NO: 789021 - protein, 554 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQGKCLYGACNWVGQWGRFANKCPCWVHP

SEQ ID NO: 789022 - protein, 493 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDQICGL

SEQ ID NO: 789023 - protein, 470 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPGFRSPMEKKTKCTDPSQPYTMILESCMWTRNAKGGSIRKRGLVL

SEQ ID NO: 789024 - protein, 478 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYR

SEQ ID NO: 789025 - protein, 596 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSVSLAYPASF

SEQ ID NO: 789026 - protein, 103 aa, Homo sapiens
ADQHLGRFGPALAHLRDPVLGRWDSAGPFLLACLPDKPESGPLGPPWGWTRPNRIPNDALGWEDGGTRRDEKETGHTLGSQPRPCPPGHIGTWAFSRVTARPA

SEQ ID NO: 789027 - protein, 102 aa, Homo sapiens
KKEGREKSQHVYYRMIRKWERKYPVQQNQLSNKPLSDGVTKAQRSSVSCSSGMRGRDQGKNTQVPSLCPHKFKISHKALVSSSKHGVISFYLLLNNLVATLT

SEQ ID NO: 789028 - protein, 130 aa, Homo sapiens [sequence omitted]

SEQ ID NO: 789029 - protein, 107 aa, Homo sapiens [sequence omitted]

SEQ ID NO: 789030 - protein, 117 aa, Homo sapiens
LFSSSRTFQNVFSRSAPCWPSYPKASPPPSPLRPKQAHRPQHCGRRRPNCCSSCGVAVEATRAGPDPDPDAPCPGGWEAPVGRPGARGAGESLRQLPGLGEVALSAGTPAQSQPDRG

SEQ ID NO: 789031 - protein, 141 aa, Homo sapiens
HPASTTGLSRHDESLTQGQTRTQRGDLGQGCLFSPYHTVDEINLKTAPWALTGPWILAHSTQSKLIPGKGHLLLPSSILVGWHPQSDISSEAIQSNIYLSRQGLTLSPRLECSGVITVHCNFCLLGLSDPSTSASQIVETT

SEQ ID NO: 789032 - protein, 145 aa, Homo sapiens
RDRGGPGVSSSQQRSCDPSAALMVPPPSVSFPVNEPEQLQSCPCPACPVAPLCFAHAVPLGCNTLPSLFARLTLTNPFKLCPSICCLQKALLKLLSPHLGTPTQCCRRALPSRSPGAGFCLCLAPLPICELSSQPRRVPNKCLLN

SEQ ID NO: 789033 - protein, 372 aa, Homo sapiens
MSKSESPKEPEQLRKLFIGELRFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGCGNQDSGYGRSGSYDSYNNGGRGGFGGGSGSNFGGGGSYNDFGNYNNQSSNFGPMKGGNFGADALAPRVMEANTLPNHETTGGYGGSSSSSSYGSGRRF

SEQ ID NO: 789034 - protein, 162 aa, Homo sapiens [sequence omitted]

SEQ ID NO: 789035 - protein, 83 aa, Homo sapiens
RSSPRRLLRHTLGEDSARCLSHNLLEISWSGISGCLVTPSEVLPFIPEHLWKQEAGSNGSERYSDLSISRKKKQRKKSPIRKA

SEQ ID NO: 789036 - protein, 80 aa, Homo sapiens
AGGGAWRSGHVGRAENAPGSSPGASCLSFPLGKWGFSGSRRTLMERMSRRRCTARSKTDTVLGPRAHVPGRRGSSINDQP

SEQ ID NO: 789037 - protein, 109 aa, Homo sapiens [sequence omitted]

SEQ ID NO: 789038 - protein, 168 aa, Homo sapiens
MFWRLSWGLLLGWRRFNLPRRLSWLLLLTGGKFRLYRRTWRLSWGLLLVCRRFHLFWRLSWGLLPSLRRFNLPRRLRRLSWLLLLTNGKFTLCRMTWRLGWGLLLGCRRFHLLWKLNWSLLLGLGRFFLIGRLRSYGNLHICRFNCNVGQVIMSLILTWRLNCHLMIW

SEQ ID NO: 789039 - protein, 93 aa, Homo sapiens
SRGPPVTCMYWGIRREDVGTPRKLGNELVAFEDVAVNFTQEEWALLDPSQKNLYRDVMQETFRNLASIGNKGEDQSIEDQYKNSSRNLRCTGS

SEQ ID NO: 789040 - protein, 431 aa, Homo sapiens
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRYGTMDSGTRRKNATRETTSTLKAWLQEHRKNPYPTKGEKIMLAIITKMTLTQVSTWFANARRRLKKENKMTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSR

SEQ ID NO: 789041 - protein, 322 aa, Homo sapiens
FFLRGLYIAIIFYYKDNILVTNEDQVPIVEIDDSHTSSITQDFLWFTKLSCMWEDIRWLRQSIPISSSSSTVLQTRQKMLAATAQLQNLLGTHNLGRVYYEPIKDRHGNILIVTIREVEMLYSFFNGKWMQISKLQSQRKSLSTPEEPTALDILLITIQDILSYHKRSHQRLFPGLYLGYLKLCSSVDQIKVLVTQKLPNILCHVKIRENNNISREEWEWIQKLSGSESMESVDHTSDCPMQLFFYELQMAVKALLQQINIPLHQARNFRLYTQEVLEMGHNVSFLLLSLPQTTSVQPQDRIILTTQTQGFLTSLFRCLNLV

SEQ ID NO: 789042 - protein, 103 aa, Homo sapiens
MGEPEGRWFSPGVGPLDCLGSPLIAPAKLRQLFLLPPVVACRHAGICRVLFLWRAPIHILSLSSCLCLLRCVPLHVQLLVCLPARILEVFIGTGWGRGEPGWS

SEQ ID NO: 789043 - protein, 102 aa, Homo sapiens [sequence omitted]

SEQ ID NO: 789044 - protein, 112 aa, Homo sapiens
GVQPSARSKLPYRWQQGRAAEAGPGALGPAPGALGAPCGQAGATSTRTHASWGSRVLAAAGIPGKAGTEKPGRHARPPSPGRTQQLRKDPAGRCARFPRGSGGKPSKGTLKI

SEQ ID NO: 789045 - protein, 202 aa, Homo sapiens
MEEPGATPQPYLGLVLEELGRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLSRSNSELEDEILCLEKDLKEEKSKHSQQDELMADISKSIQSLEDESKSLKSQIAEAKIICKTFKMSE

SEQ ID NO: 789046 - protein, 195 aa, Homo sapiens
ISCGLFQDGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAACCAALSDRETRLQEVRSAFLAAYSSTVGLRAVAPSPSGAIGGLLEQFARGVGLRSISSNAL

SEQ ID NO: 789047 - protein, 255 aa, Homo sapiens
ISCGLFQDGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGEQSPGGPQTQLAALSDRETRLQEVRSAFLAAYSSTVGLRAVAPSPSGAIGGLLEQFARGVGLRSISSNAL

SEQ ID NO: 789048 - protein, 98 aa, Homo sapiens
DFPTKRPPVFRAGVITIATLVENKKAQLVVTGHDVDPIELVVFCLPPASAASSGKWVMIGRVWWLTPVIPALWEAEAGRSRGQEIKTILANMVKPRLY

SEQ ID NO: 789049 - protein, 131 aa, Homo sapiens
ASELPLKAGAQLGSTLEGNSRAATYSRSFNPAVPQPTHNGSKGWSSEKDLLLANHHSHFPVMLSGIRALISTYGMQDMVGGKGNYRQKPCESIKVTDRLDTRMRNKSSIIITENHQIAKDKKGIRHGGSSL

SEQ ID NO: 789050 - protein, 158 aa, Homo sapiens
LLFAKQEPCSHLNIFQANGILIFLRVLSPSRGRALAPLWPQDVNLCCLSQPRCSHSPSAMTLLGLVIGCPASPGLMRWPLQEDMWRRVSSPGGGSTWRKWFFSETLSYLHTMPVTMSSLYPPKTAEKKEGRNLDLSYDVTELASPGVFYLCPPCYETQ

SEQ ID NO: 789051 - protein, 121 aa, Homo sapiens [sequence omitted]

SEQ ID NO: 789052 - protein, 117 aa, Homo sapiens
QLESSSSDHFPNANGTPGLENSNFRYPIPGIPGVFMAVRALSACMYLARCPRPGMSTLSIVVVFLSLCTLLLMMSFSLSKSFTKLLLWFECVPQTSCIRKLRLGAVAHTRNHSTLGG

SEQ ID NO: 789053 - protein, 67 aa, Homo sapiens
LTGRTGGNPARAHLFSRMICRFYKWLQVPLRKAWDDFWGALAAVVQGPSQGNLASLSIMGLWMPAVT

SEQ ID NO: 789054 - protein, 125 aa, Homo sapiens
QYRHSWGARDPFFCQAASFCKPQGGRVPAVGQTSARPIRTPLSSGSNAAKEEAGGSVQRTVGVGSQGGIVEECGFPQAPLQAFTSSLCCKDVRMTDFGSHANQVPADLITHPLLFQDQEINFFCD

SEQ ID NO: 789055 - protein, 81 aa, Homo sapiens
MFPLHGGLPGGDGPEGGGGCVGALLEPGMNRCRMAALRVGGSEKKKKTPRRAISCALGVSRLCCLLSSQNLHTLFWWLGQI

SEQ ID NO: 789056 - protein, 111 aa, Homo sapiens
GLLTRTVLLLVVGTLRCWRVHVSLSRLATSLTPRTKWEPGLPHPLPVPSSAELSATDFCALYVSLGMKSPALDVRRDPVGWLRNICNFLLDTYLVPGTGKAVLHTLYIILP

SEQ ID NO: 789057 - protein, 119 aa, Homo sapiens
TTVFDSCNQSWVKKETAGTEQENCCGAWSPTPRLALFEELPTCAGLSSRGNTASADGAAVSPSTSQVPTPSPRPFSKGHSLPLLSFSTECKMSVLSEKSMTPVNWLCFCQRCKGLSFPS

SEQ ID NO: 789058 - protein, 135 aa, Homo sapiens
MLQGDHISVESRKTNFLNFSIYFCEKKKKARKYETECLISKILGFPVLLCYLYTQAKGEVFTGSKFQHLPTTWIPINFKHCVIRKNGQYCRHLSISIHILSTHTMLSFRYGTCKLEIIFRTFFLENILKLCSKNL

SEQ ID NO: 789059 - protein, 757 aa, Homo sapiens
MAGCIPEEKTYRRFLELFLGEFRGPCGGGEPEPEPEPEPEPEPEPESEPEPEPELVEAEAAEASVEEPGEEAATVAATEEGDQEQDPEPEEEAAVEGEEEEEGAATAAAAPGHSAVPPPPPQLPPLPPLPRPLSERITREEVEGESLDLCLQQLYKYNCPSFLAAALARATSDEVLQSDLSAHYIPKETDGTEGTVEIETVKLARSVFSKLHEICCSWVKDFPLRRRPQLYYETSIHAIKNMRRKMEDKHVCIPDFNMLFNLEDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 789060 - protein, 156 aa, Homo sapiens [sequence omitted]

SEQ ID NO: 789061 - protein, 156 aa, Homo sapiens [sequence omitted]

SEQ ID NO: 789062 - protein, 301 aa, Homo sapiens
KKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASQVRGVAGQCDPKSGHQEKTNYLGYVRVRRGYNTGIRKQPAEMAEGVVPALLKQPSHSDSGPKARSSPHRQLTTSRHHIHNSLPL

SEQ ID NO: 789063 - protein, 33 aa, Homo sapiens
MIAASRGCYGDAICYVYSYVYKAMSIKHTAFHT

SEQ ID NO: 789064 - protein, 82 aa, Homo sapiens
PGGDVLVGRAVAPGNTGWKWNRNEQGESRHHLGDSQGEESWIPGLSRKLLLCLIPNELKAGPSTPAGMCESRLVTTRRAGLN

SEQ ID NO: 789065 - protein, 131 aa, Homo sapiens
PALKSTTALKASNRRTPHTVCRRFAVSSVEHHTQYAGALQFPLWNTTHSMPALCSFLCGTPHTVCRRFAVSSVEHHTQYAGALQFPLWNTTHSMPALCSFLYETTLLSLTLTKNVSLQGRPSWPSQALSRG

SEQ ID NO: 789066 - protein, 67 aa, Homo sapiens
SHLCKGVPGTGGPITNLTCCQSQYISYSALELGPQCHLLFLRTLLHQPSGGSYSCCWNLAIWASLSG

SEQ ID NO: 789067 - protein, 67 aa, Homo sapiens; identical to SEQ ID NO: 789066

SEQ ID NO: 789068 - protein, 349 aa, Homo sapiens
CLGLRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAEGTEPPEQQELGNFFRSLWGPYAGWGPAVLFSADLRQCSHAQEPPEKRRKGSKGPEGMGPGERNSPSTFPPHISLFPSSHVGEGPPFDYLKGQAPPNQAVSC

SEQ ID NO: 789069 - protein, 143 aa, Homo sapiens
GRLLPFKAGLARAVGGPEEVRGPSVMPPPPPRQGCSLRFRVATAAGPVQVRGARLPSFAAPERGLAQVRAVPGSPGSARGPGSTVAAWGWASSLNRSWELGSWRVQDENSVALLPRSCLWFRDQKGVLRTGGRNPGVAYWKAH

SEQ ID NO: 789070 - protein, 143 aa, Homo sapiens; identical to SEQ ID NO: 789069

SEQ ID NO: 789071 - protein, 336 aa, Homo sapiens
SALRLLFSAHSRRGLLAAEALSRGLVPSGSLPEQLLLQGGSGAGAVQLPGAENRRARHPPLPCKGHEKGSSWRSADMEEDLFQLRQLPVVKFRRTGESARSEDDTASGEHEVQIEGVHVGLEAVELDDGAAVPKEFANPTDDTFMVEDAVEAIGFGKFQWKLSVLTGLAWMADAMEMMILSILAPQLHCEWRLPSWQVALLTSVVFVGMMSSSTLWGNISDQYGRKTGLKISVLWTLYYGILSAFAPVYSWILVLRGLVGFGIGGVPQSVTLFAEFLPMARAKCILLIEVFWAIGTVFEVVLAVFVMPSLGWRWLLISQLSAPLFAVLCFWLLKCK

SEQ ID NO: 789072 - protein, 123 aa, Homo sapiens
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARG

SEQ ID NO: 789073 - protein, 187 aa, Homo sapiens
SKPEVVIIHDAVRPFVEEGVLLKVVTAAKEHGCSDYDLEFGTECLQLALKYCCTKAKLVEGSPDLWKVTYKRDLYAAESIIKERISQEICVVMDTEEDNKHVGHLLEEVLKSELNHVKVTSEALGHAGRHLQQIILDQCYNFVCVNVTTSDFQETQKLLSMLEESSLCILYPVVVVSVSEINADFSQ

SEQ ID NO: 789074 - protein, 255 aa, Homo sapiens
SKPEVVIIHDAVRPFVEEGVLLKVVTAAKEHGCSDYDLEFGTECLQLALKYCCTKAKLVEGSPDLWKVTYKRDLYAAESIIKERISQEICVVMDTEEDNKHVGHLLEEVLKSELNHVKVTSEALGHAGRHLQQIILDQCYNFVCVNVTTSDFQETQKLLSMLEESSLCILYPVVVVSVHFLDFKLVPPSQKMENLMQIREFAKEVKERNILLYGLLISYPQDDQKLQESLRQGAIIIASLIKERNSGLIGQLLIA

SEQ ID NO: 789075 - protein, 63 aa, Homo sapiens
MAEAWNGTRPPRKRGVQSAKCHFSLSSPTFKEERDDLTPGPTVIYQHNLKKTPKEAKEVRLEL

SEQ ID NO: 789076 - protein, 81 aa, Homo sapiens
NCPSTHPLKPDICLGVALATCLPDGPQTNRPLPSECATSRILILLASPRPLLESAPHHLFVATLPTASPLPAKPPAHGPPG

SEQ ID NO: 789077 - protein, 30 aa, Homo sapiens
MGVTLWLSMNSCDYSPTVGLNNQTADTTGA

SEQ ID NO: 789078 - protein, 250 aa, Homo sapiens
KRRSQALKASDHLSPGGPAGKGGAGDPQGAGADPGNQGHRCGRMGVTEAARLQAHTSHISLLSEGAKMHRWGSLPRNRGARRIATPGLGARASRSPERVKRTTCPVLQIEAFAGRDIGKKGGEGVQRKVGTAEFGISAETGKKINRSTSYMQSHGNCLGKRKWQRLGPLGQPGPVGCACEVSSSGAGPAAAVDRGGPCTSAPAAAPGNLSPDSRLLQNPLPAHLTANFASEGLEGVPGSCFPSCGTLPFP

SEQ ID NO: 789079 - protein, 122 aa, Homo sapiens
PAWSWWGSREEKVTQTLTPAEGAARQEEYRCAERPGSAIPASPVVSPAGPTCGPGLLPATQSSRIPLTILGSAAAPRGSPHASCLPLGSCQAQSPIPEGGPCFLLHALYPRALPGPVLSLQS

SEQ ID NO: 789080 - protein, 59 aa, Homo sapiens
MQTGGCEPKHRRMCPDDSSENIMKWRTFLPEERTVTQAGDVTHTLGSKGPKAGVPFTGP

SEQ ID NO: 789081 - protein, 273 aa, Homo sapiens
RKRRHSSSERYCQLMPGANYRAGAGAGAGARRPRGARDREEDGGGLEPAAVARDLLRGTSNMSFEELLELQSQVGTKTYKQLVAGNSPKKQASRPPIQNACVADKHRPLEMSAKIRVPFLRQVVPISKKVARDPRFDDLSGEYNPEVFDKTYQFLNDIRAKEKELVKKQLKKHLSGEEHEKLQQLLQRMEQQEMAQQERKQQQELHLALKQERRAQAQQGHRPYFLKKSEQRQLALAEKFKELKRSKKLENFLSRKRRRNAGKDRRHLPLSKE

SEQ ID NO: 789082 - protein, 267 aa, Homo sapiens
RKRRHSSSERYCQLMPGANYRAGAGAGAGARDREEDGGGLEPAAVARDLLRGTSNMSFEELLELQSQVGTKTYKQLVAGNSPKKQASRPPIQNACVADKHRPLEMSAKIRVPFLRQVVPISKKVARDPRFDDLSGEYNPEVFDKTYQFLNDIRAKEKELVKKQLKKHLSGEEHEKLQQLLQRMEQQEMAQQERKQQQELHLALKQERRAQAQQGHRPYFLKKSEQRQLALAEKFKELKRSKKLENFLSRKRRRNAGKDRRHLPLSKE

SEQ ID NO: 789083 - protein, 273 aa, Homo sapiens; identical to SEQ ID NO: 789081

SEQ ID NO: 789084 - protein, 273 aa, Homo sapiens; identical to SEQ ID NO: 789081

SEQ ID NO: 789085 - protein, 83 aa, Homo sapiens
LLLLLLLNSRPVDQGAETQQEIGELLESKEATKCRQGQETSPFEQRVIRNYPLLCHCPRETWICEDRFGHGWFPFKGKDHSCP

SEQ ID NO: 789086 - protein, 184 aa, Homo sapiens
RKRRHSSSERYCQLMPGANYRAGAGAGAGARRPRGARDREEDGGGLEPAAVARDLLRGTSNMSFEELLELQSQVGTKTYKQLVAGNSPKKQASRPPIQNACVADKHRPLEMSAKIRVPFLRQVVPISKKVARDPRFDDLSGEYNPEVFDKTYQFLNDIRAKEKEVYSLRLVYGEFCGVENEGTG

SEQ ID NO: 789087 - protein, 158 aa, Homo sapiens
MSSRKYQYRSKVWGKLGVGATYLGITSISAAIEDIRMNDSILGVNRKERLVKKQLKKHLSGEEHEKLQQLLQRMEQQEMAQQERKQQQELHLALKQERRAQAQQGHRPYFLKKSEQRQLALAEKFKELKRSKKLENFLSRKRRRNAGKDRRHLPLSKE

SEQ ID NO: 789088 - protein, 276 aa, Homo sapiens
RKRRHSSSERYCQLMPGANYRAGAGAGAGARRPRGARDREEDGGGLEPAAVARDLLRGTSNMSFEELLELQSQVGTKTYKQLVAGNSPKKQASRPPIQNACVADKHRPLEMSAKIRVPFLRQVVPISKKVARDPRFDDLSGEYNPEVFDKTYQFLNDIRAKEKELVKKQLKKHLSGEEHEKLQQLLQRMEQQEMAQQERKQQQELHLALKQERRAQAQQGHRPYFLKKSEQRQLALAEKFKELKRSKKLENFLSRKRRRNAGKDRRHLPLTNVILS

SEQ ID NO: 789089 - protein, 107 aa, Homo sapiens
RKRRHSSSERYCQLMPGANYRAGAGAGAGARRPRGARDREEDGGGLEPAAVARDLLRGTSNMSFEELLELQSQVGTKTYKQLVAGNSPKKQASRPPIQNACVADKHR

SEQ ID NO: 789090 - protein, 179 aa, Homo sapiens
LFPDEADQRQYEEWLFHTQQLLQMQLKVLEEQIGVHRKSRKALCAKQRTAKKAGREFPEADAEKLKLVTEQQSKIQKQLDQVRKQQKEHTNLMAEYRNKQQQQQQQQQQQQQQHSAVLALSPSQSPRLLTKLPGQLLPGHGLQPPQGPPGGQAGGLRLTPGGMALPGQPGGPFLNTALA

SEQ ID NO: 789091 - protein, 213 aa, Homo sapiens
LFPDEADQRQYEEWLFHTQQLLQMQLKVLEEQIGVHRKSRKALCAKQRTAKKAGREFPEADAEKLKLVTEQQSKIQKQLDQVGESKLQPSTQKAGKRVGMGGACPSLTSPTLPCEVRKQQKEHTNLMAEYRNKQQQQQQQQQQQQQQHSAVLALSPSQSPRLLTKLPGQLLPGHGLQPPQGPPGGQAGGLRLTPGGMALPGQPGGPFLNTALA

SEQ ID NO: 789092 - protein, 109 aa, Homo sapiens [sequence omitted]

SEQ ID NO: 789093 - protein, 77 aa, Homo sapiens
NRAGTNADIHPGLAAKAFYRPAQITLTALSLPIFPNPLSTPAKINNQITLCSPHMSYADFHISPTISSIWKALPKTC

SEQ ID NO: 789094 - protein, 134 aa, Homo sapiens
PSQAHHYHPSNSDIATEIMHNLLTRGSPPLTTHPPSSLPCPAPRKHAYHLHKTLPHLPFIYQIKSTHPGLAAKAFYRPAQITLTALSLPIFPNPLSTPAKINNQITLCSPHMSYADFHISPTISSIWKALPKTC

SEQ ID NO: 789095 - protein, 257 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENTVKSRYELDDH

SEQ ID NO: 789096 - protein, 104 aa, Homo sapiens
CFILMMISYFQIFSTVLRIPSGQSRAKAFSTCSPQLIVIMLFLTTGLFAALGPIAKALSIQDLVIALTYTVLPPFLNPIIYSLRNKEIKTAMWRLFVKIYFLQK

SEQ ID NO: 789097 - protein, 147 aa, Homo sapiens
MLPMGKERPTAFAATATTAITATTAATATATTTTITTMAATATATSSLFSLLSSSSSSSSSSSLFSFRLLLPPLPPPLPPPLPPTFSSSSSSSSFFLLFLPLLLSPSSFSLPLFLPLRLPFLPSSPLPFPPSFFLSFSLLLLFLPLL

SEQ ID NO: 789098 - protein, 162 aa, Homo sapiens
GAGVLALLCPPHPLSVLSILGCFGVFYSPAALWSCHPELTSLPSAGCLQPLRETTAPPSAEAALGAAEGRRVDTNLASGRHQGLPQSGVDTGPILLSCSLQPRGPSAGASPWQLHPRPIRSQHLGPGMCLATRFPAILTKVRQPLAYSLRMTSKQLAFPWAA

SEQ ID NO: 789099 - protein, 98 aa, Homo sapiens
LSDSQVKSCYSVDLLDKGKIHVLRGTEPDGPRFHHTTQNCSCCCKWIPKPLLIDPPYIASVHLSFCTSCLLSQSFNANSTTACSWKLMIRNLEPSGFS

SEQ ID NO: 789100 - protein, 50 aa, Homo sapiens
MGRQMRLCLKKKKKKRKEIRNKSWKQQPTSHVGWAAAALVRLSNPIQAAL

SEQ ID NO: 789101 - protein, 90 aa, Homo sapiens
WRQGSAPGSYLRSGTGDESVRGVTRTLSHPPRSRRRAQAPRAQDQVACSCREAPFAPVGTGCGYLSVIPGTNERDEQDHLHRPPPSLTTL

SEQ ID NO: 789102 - protein, 120 aa, Homo sapiens
EVQDQPGQHKATPSLQKSFLTKITRACGMPPVLPATWEAKVEGLLEPSSSKLRWATITPLHSCLSSRVRPRLINKQTKNRINELLYSVTLKPNNLSYTLIIKHWSFGKYWLTELCTDSVC

SEQ ID NO: 789103 - protein, 203 aa, Homo sapiens
MNFNVWNIKEMLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDSCRRLWKSLRTISVQEANLFWILWRLWPRHVSASCLRYQQRALVNDEHELSDPSLVSSGEVPHRVSDERMGI

SEQ ID NO: 789104 - protein, 139 aa, Homo sapiens
MNFNVWNIKEMLSIPSGSGNKKSSNWNNNQNDYSSLSDSQFLFGSQFCPENSETLSAPLDFGAHLRHSKQSQQNYLEGEPSIFTKYQTKPQLFGGDIKDGGLFPPPLSVGKSKGLLEQFEEKKKRAKDKCDRYVNLSNG

SEQ ID NO: 789105 - protein, 203 aa, Homo sapiens; identical to SEQ ID NO: 789103

SEQ ID NO: 789106 - protein, 116 aa, Homo sapiens
PWGNVLCDIATRPRRTRPCESTLYDTPSPPLRRYFVIFSPPNLRRYLVIFFPTPILKKILCNIVPPYLKKIFCNILPPLRMYFVKSVPSPQKIAPGRARWLTPVIPALWEAEAGRS

SEQ ID NO: 789107 - protein, 210 aa, Homo sapiens [sequence omitted]

SEQ ID NO: 789108 - protein, 175 aa, Homo sapiens
SASAQPQSVRRQLCRAQTGSGWGGPQVLNLVPGEPERTLEQEEKEKLVSEAPPPPGAMQSLRPEQTRGLLEPERTKTLLPRESRAWEKPPHPACTKDWEAVEVGASSHDSDEKDLSSQETGLSQEWSSVEEDDESEGSQGFVEWSKAPQQTTIVLVVCVLFLFLVLTGMPMMFHI

SEQ ID NO: 789109 - protein, 196 aa, Homo sapiens
MDCRAFHYNVSSHGCQLLPWTQHSPHTRLRHSGRCDLFQEKGTCPRSGMAWKRTSAVTLMATPEVLGATQQTLPCASRAAASNPAGRVCLVQWRGIPRRVDRTESGRECQRWDLQHPHQHPFEPGKFLDQGLDDNYCRNPDGSERPWCYTTDPQIEREFCDLPRCGRRRGPGLGGYLGTLGRGVAWPGRSEGLGVT

SEQ ID NO: 789110 - protein, 104 aa, Homo sapiens
LGYSTQLKPKAFFLGNNPGLSDGLSLGQAAGPTPSPWCCGNTEYKRQTEGLKSSQKREITYARLPVKLIAGYSIAAIQVRIQWNNTCKVLRENNSQPRVQDPAK

SEQ ID NO: 789111 - protein, 67 aa, Homo sapiens
CFAEYRYKCQIYSSSLCCCEHGELELERFWQESSGLAAPKSWICYCLAERPWMCPFNLAEPVSASVK

SEQ ID NO: 789112 - protein, 152 aa, Homo sapiens
QTSYPPALRVSSAGPLTRSHLGPHVPAVLKAHCPLRTRHFCPSAQTVFSAWSTSPSLALLGRASLSSKISKASSHPANSSEFLTGILWPPPPASSKPPWFGLSEHTGFVLSLRMLYSQGRDGDFFLPSCVPRAQQDKEASANMQSIRGTECG

SEQ ID NO: 789113 - protein, 43 aa, Homo sapiens
MMCDFTEDQTTEFKEAFQLFDRTGDGKILYNQCGDVMRPLGQN

SEQ ID NO: 789114 - protein, 101 aa, Homo sapiens
GLMGTHGSQARAPDGAPAGRRVPHLGTTLDRALVIATITKAQEAGPDETSVHGVPRLCVGSGLACFTPCCGRAGLTSSDRRLCLLARRPARLAMVTWRGRH

SEQ ID NO: 789115 - protein, 178 aa, Homo sapiens
MAGQRTCQRRSSRAGPGKMQEPPKSIEEFLKFQNWDYWPREIHFRDDDKWSCTLKKIKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLLFKSP

SEQ ID NO: 789116 - protein, 107 aa, Homo sapiens
AGTTAGGGLDGKFRLSLSISGGVALLPRGSGEGQGRVRPGPASSLAAFHPVSSRFLLGQQNWEAVLETYCQGVVAVSCEEMLIPEKSLHFAHLKDILIFGRPTHIEA

SEQ ID NO: 789117 - protein, 107 aa, Homo sapiens; identical to SEQ ID NO: 789116

SEQ ID NO: 789118 - protein, 107 aa, Homo sapiens; identical to SEQ ID NO: 789116

SEQ ID NO: 789119 - protein, 84 aa, Homo sapiens
AGTTAGGGLDGKFRLSLSISGGVALLPRGSGEGQGRVRPGPASSLAAFHPVSSRFLLGQQNWEAVLETYCQGVVAFGRPTHIEA

SEQ ID NO: 789120 - protein, 103 aa, Homo sapiens
AGTTAGGGLDGKFRLSLSISGGVALLPRGSGEGQGRVRPGPASSLAAFHPVSSRFLLGQQNWEAVLETYCQGVVAVSCEEMLIPEKSLHFAHLKDILIEFQES

SEQ ID NO: 789121 - protein, 84 aa, Homo sapiens; identical to SEQ ID NO: 789119

SEQ ID NO: 789122 - protein, 107 aa, Homo sapiens
SKQSYCLLCFQYRCRIRLLPTTLAVTILSRPLSHITWIIAVTCQFLCSDLKPFDIGARILLPKLCESNQITALFKSLQWFPRPLKIKNLSSYYNLWDSTCSDSTLPL

SEQ ID NO: 789123 - protein, 87 aa, Homo sapiens
MEQQGVEYQHNSQLLPVPRPCFQECFLAGSFLIDREFVICILRKVVVVDALLSQILEIRDDYVPFLFGEFPSLYVPPCSRLSSSPLP

SEQ ID NO: 789124 - protein, 86 aa, Homo sapiens
NRHTLQNKTIILDLAACRPATGLQFNNCALSANPGPGPESGPTNETQSQASRNQLSIKQQITTRSCGVYNDETEKVQRDKAQFTIH

SEQ ID NO: 789125 - protein, 109 aa, Homo sapiens
MPIKRLSLLCLPSSVLASIPSDQPCIPTPASLLQEALPPQLSCTILTFHAGLQHMPLCGPSSTLWKSQQRTQAGQMPMRVFGEKYITRDETTINDGMYADLRNVRWSAG

SEQ ID NO: 789126 - protein, 149 aa, Homo sapiens
MPIKRLSLLCLPSSVLASIPSDQPCIPTPASLLQEALPPQLSCTILTFHAGLQHMPACAVGQRHGRLPWARLFQPSIQLARQGFPVVKGLAAALENKQTVIEQQPVLCEVFCRDRKVLREGDRLTCRSWLTPIERMAYSTCPGNRNRLR

SEQ ID NO: 789127 - protein, 70 aa, Homo sapiens
VGIPGQPRAPDSAPRGDMDRMASSMKQVPNPLPMCCRPAGSALGWRRRSARASSGLRVAVGLALPPAYPV

SEQ ID NO: 789128 - protein, 90 aa, Homo sapiens
VGIPGQPRAPDSAPRGDMDRMASSMKQVPNPLPMCCRPAGSALGWRRRSARASSGLSSCRGDTRRRRKEKSRSPVLNRVLQSPPRIPLSL

SEQ ID NO: 789129 - protein, 125 aa, Homo sapiens
STTQGEESDKVSSLGGSWAAGSASKIITSNPDSAKPQPGNYFSQGVPALRARSGLQRQVYTPCQQNPFPDLCTSQPILRHAAFDDRKPTASHDGPSDFQTSLILKPAQPSYSSYPISPRTDFIVF

SEQ ID NO: 789130 - protein, 91 aa, Homo sapiens
PQFNSQDSQPRCVSHIAIAYDMHLHGFLLLQQGISSSCLPIMKKKISATTCPDAEKLAASKTVVHLANFLFQAFYCKENWPPWIKNISTFA

SEQ ID NO: 789131 - protein, 141 aa, Homo sapiens
WCFLPCTSDLCGVDGLVLRVPLDPVSLDPVFYLLPGHFGLLMSQDQQVRREVTVLAGGIGRGHVCETQASRLVPRAPLYWPQGLSHAPGEPLRLARVIAAAGGGIRNGGRDVHQLWPRDPWQGGEAGESLEVALANAQGSE

SEQ ID NO: 789132 - protein, 57 aa, Homo sapiens
RARYPAFFLSFTLVAVSQNHATVLQPGNKSETQKEEEEEEEEKEKKKGRRRRRRRRR

SEQ ID NO: 789133 - protein, 329 aa, Homo sapiens
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLG

SEQ ID NO: 789134 - protein, 106 aa, Homo sapiens
IFTCDTTTETATACMVFLCSLLPVHIGRGHVLSVGTLPLSSLFILSIFHMDTLEKSMSFVVVVVVVVVVVVGGGSLVSYCLFIESSVGVLRCFQVLICDKLSLCRV

SEQ ID NO: 789135 - protein, 67 aa, Homo sapiens
MSKNEHRKGRDGDKCARQREWQAQRPAGMGAPSPCEALPLLPVQDGGGGGQPSIKHWNSSGRDGALR

SEQ ID NO: 789136 - protein, 188 aa, Homo sapiens
TENGKRTPFANEKTTSSSAEPTEHAERTPLANENTTSSPAEPTENRERTANEKTTQFPAEPTENRESTANEKTTPFPAEPTENREWTANENTTLSPAEPTEHEEMTPLANEKTTLSPAEPTENGERTPFTNEKTTPSSAEPTEHGERTPLANEITTPSRAEPTEHGERIANEKATPSPAKPTEHGETT

SEQ ID NO: 789137 - protein, 276 aa, Homo sapiens
SAAPTADSHSSSDKSVPGAQLLSTDHKHPAETMGPPSAAPRGGHRPWQGLLITASLLTFWDPPTTVQFTIEALPSSAAEGKDVLLLACNISETIQAYYWHKGKTAEGSPLIAGYITDIQANIPGAAYSGREQVYPNGSLLFQNITLEDAGSYTLRTINASYDSDQATGQLHVHQNNVPGLPVGAVAGIVTGVLVGVALVAALVCFLLLSRTGRASIQRDLREQPPPASTPGHGPSHRSTFSAPLPSPRTATPIYEELLYSDANIYCQIDHKADVVS

SEQ ID NO: 789138 - protein, 45 aa, Homo sapiens
MCIQRVSYSSQYLVNPEKLPSEPILTVRYKNSHPERLQNVVPLWF

SEQ ID NO: 789139 - protein, 171 aa, Homo sapiens
MATGFMLPPTLSSELSMALPLIGHKTRVTCLSDLAFLAITWFPLRSSWPVEAEGCFYRQGIIDGLADEVISEGLAQCPKGRESALRGGLVFPSKFIQTAVKFKRSSSGLQPPFIWQQRSTTVKKSRYFKLWKRHRVTLKLDRASSYFQNLHSGPFVPFRGSFEEWVKATSS

SEQ ID NO: 789140 - protein, 243 aa, Homo sapiens
GGGATSGPRRRRQRPIASRAGAGQGVGCSSRRRRPVHGGLYKKMQAHELFRYFMKLVFRYVRTLPLGFGAFAFWATKLCDLSMQVEVAGGGAALLSDEPLVIISNEMNVTTIKQKAFQKGNTCQNKWPLLLSENDQTLNWRFNRVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKII

SEQ ID NO: 789141 - protein, 121 aa, Homo sapiens
LVRVPALRAAKSSGSVRSQTPKRPPHRRVARPPPGFLGSSTSDHSPCLPSSKEQALLVFPGSPVVRPTPGPFPMAACPAAQGSPPCTVLPAQSLWHAGPKAVGRVRGHCRPEPPFFHGVRP

SEQ ID NO: 789142 - protein, 113 aa, Homo sapiens
ILVVSPQLTQIWGCNSVQLTQRGSGSLELRSVVRLHSGHTLRPWQIWLPWNSGCQLFPVHTLDLCCFPLRAASIPPPIISYPQTHPSSPGQPPHPPPITLHLPLSQTTRVSHL

SEQ ID NO: 789143 - protein, 142 aa, Homo sapiens
PLTAPTLLCSLAHTGVWDLLPPTTIPCRKLVLPWKTVTICVMRAGVKCKSFLHPQIMQELWQLTKQTNRTETFRHSSPSLTMPILPRWAGMQGASHFGVALPTKYTTGLCVLGGLMHREMGWDTCTAQQRQRQARGQGPATP

SEQ ID NO: 789144 - protein, 134 aa, Homo sapiens
TCTDMNAYTCARRHSSTYSDHITLQGAFACTHTWAQSCTCQPPPTPAAKCLDRGQSSGMLHAGCVGWGGGTHVRVDLSSQLNRRVRPHLCMLRCWSSCHRASVSCTHPSLHTTGPVLISARTGADHTWYTAGTY

SEQ ID NO: 789145 - protein, 91 aa, Homo sapiens
GSQGWLDLGSILDEAGDEQSEACKRSSVLRSGINQHQPKVPEKSRWAQDAEHQAAPRQSHSETCIHPDNLAPPMFTHTVEASASGGTTDHL

SEQ ID NO: 789146 - protein, 292 aa, Homo sapiens
WLPESARYDVLSGNQEKAIATLKRIATENGAPMPLGKLIISRQEDRGKMRDLFTPHFRWTTLLLWFIWFSNAFSYYGLVLLTTELFQAGDVCGISSRKKAVEAKCSLACEYLSEEDYMDLLWTTLSEFPGVLVTLWIIDRLGRKKTMALCFVIFSFCSLLLFICVGRNVLTLLLFIARAFISGGFQAAYVYTPEVYPTATRALGLGTCSGMARVGALITPFIAQVMLESSVYLTLAVYSGCCLLAALASCFLPIETKGRGLQESSHREWGQEMVGRGMHGAGVTRSNSGSQE

SEQ ID NO: 789147 - protein, 83 aa, Homo sapiens
GGVWLRCFPRGLLCPPGDLPQVLTGLSRGPPVEPGPPLPGLGPSRTPHLWDWAWLVPMTELSGEATFSWLQESHGPGILGVHP

SEQ ID NO: 789148 - protein, 297 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADAPTVPPQEATLVALVSSLLVVFTLAFLGLFFLYCKQFFNRHCQRGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 789149 - protein, 198 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADAPTVPPQEATLVALVSSLLVVFTLAFLGLFFLYCKQFFNRHCQRGKGGCFMFHMNQEQGSYWQKRGMFWG

SEQ ID NO: 789150 - protein, 122 aa, Homo sapiens
RSLEELVSAAGQDCAEVDAILREISERCDEALQSRDPKRPRLLPEPANTDTRPGNLHGAFRGLRTDCSRSALNLSHSELEEGGSFSTRIRSHSTIRTLAFPQGNAFTIRTANGGYKFRWVPS

SEQ ID NO: 789151 - protein, 357 aa, Homo sapiens
MRRTGPEEEACGVWLDAAALKRRKVQTHLIKPGTKMLTLLPGERKANIYFTQRRAPSTGIHQRSIASFFTLQPGKTNGSDQKSVSSHTESQINKESKKNATQLDHLIPGLAHDCMASPLATSTTADIQEAGLSPQSLQTSGHHRMKTPFSTELSLLQPDTPDCAGDSHTPLAFSFTEDLESSCLLDRKEEKGDSARKWEWLHESKKNYQSMEKHTKLPGDKCCQPLGKTKLERKVSAKENRQAPVLLQTYRESWNGENIESVKQSRSPVSVFSWDNEKNDKDSWSQLFTEDSQGQRVIAHNTRAPFQDVTNNWNWDLGPFPNSPWAQCQEDGPTQNLKPDLLFTQDSEGNQVIRHQF

SEQ ID NO: 789152 - protein, 298 aa, Homo sapiens
MRRTGPEEEACGVWLDAAALKRRKVQTHLIKPGTKMLTLLPGERKANIYFTQRRAPSTGIHQRSIASFFTLQPGKTNGSDQKSVSSHTESQINKESKKNATQLDHLIPGLAHDCMASPLATSTTADIQEAGLSPQSLQTSGHHRMKTPFSTELSLLQPDTPDCAGDSHTPLAFSFTEDLESSCLLDRKEEKGDSARKWEWLHESKKNYQSMEKHTKLPGDKCCQPLGKTKLERKVSAKENRQAPVLFQDVTNNWNWDLGPFPNSPWAQCQEDGPTQNLKPDLLFTQDSEGNQVIRHQF

SEQ ID NO: 789153 - protein, 357 aa, Homo sapiens; identical to SEQ ID NO: 789151

SEQ ID NO: 789154 - protein, 93 aa, Homo sapiens
EAPGSLRRRPAGFVSSAAMRRTGPEEEACGVWLDAAALKRRKVQTHLIKPGTKMLTLLPGERKANIYFTQRRAPSTGIHQRSIASFFTLQPDV

SEQ ID NO: 789155 - protein, 121 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTSKHHV

SEQ ID NO: 789156 - protein, 1216 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 789157 - protein, 377 aa, Homo sapiens
MVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 789158 - protein, 377 aa, Homo sapiens; identical to SEQ ID NO: 789157

SEQ ID NO: 789159 - protein, 1216 aa, Homo sapiens; identical to SEQ ID NO: 789156

SEQ ID NO: 789160 - protein, 1137 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCR

SEQ ID NO: 789161 - protein, 1188 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 789162 - protein, 405 aa, Homo sapiens
MVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 789163 - protein, 405 aa, Homo sapiens; identical to SEQ ID NO: 789162

SEQ ID NO: 789164 - protein, 1216 aa, Homo sapiens; identical to SEQ ID NO: 789156

SEQ ID NO: 789165 - protein, 1216 aa, Homo sapiens; identical to SEQ ID NO: 789156

SEQ ID NO: 789166 - protein, 597 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVVIFP

SEQ ID NO: 789167 - protein, 119 aa, Homo sapiens
GPKADAGRICLREEPPPGLNRRGPVRNVHLSGGSCGCEGHKQERGRSLRGGFPHAGGALRRRGPQGPGVLTPPRPGRVREPLVLPRPSRSWPRTQPGTQRPSAPGSARTLRARRSRTAR

SEQ ID NO: 789168 - protein, 126 aa, Homo sapiens
MFDPSHSMGVMSKLGLTDVGPSLSAPHAAFLKLGFSSERKECQRCIVACAFLPKLPDKLTRFSCLKRVKLHLFCPSSSNKSCKYTPLGKRQMVTKLLLSGIEIISDRHWNNFLNYYYLSSTLLHSP

SEQ ID NO: 789169 - protein, 117 aa, Homo sapiens
SQRRGSAVRGRSSGLDVARPVGQCPSWAGPVPPAPIPAETRHPPPPLPPPCRAPAPRPTPGGTCPLQLTLDVLYSLAAPAAVPLTAQVMALLSSQWLKFTLSFPCLTHARHIKACWH

SEQ ID NO: 789170 - protein, 419 aa, Homo sapiens [sequence omitted]

SEQ ID NO: 789171 - protein, 150 aa, Homo sapiens
MWSPAPKASFWSPLSTRSGGTHACSASMRQPCASPWSQGNISSTRPSLLRCANSLPSTKDKAKGPLLAGHPCPIFSPGPFPCGHREVWPEYPTPAPLHPELGATSEVSSLSEHAFPCSSRGLSRLSDAGAERPGRKGVQPVVCKALVGTC

SEQ ID NO: 789172 - protein, 92 aa, Homo sapiens
ASARKRRGTRLRRQSILARTSQGAKTRGTHGQTTDRRRTGRWTPLPPPSPRHLRPEDEPSLQGHGCGAPRQRRPSGALCPPGRGALMRAPLQ

SEQ ID NO: 789173 - protein, 100 aa, Homo sapiens
AGGAGGGARPGRSHFGARETIGRKRRGTRLRRQVKLASYGPSARGALREIFSGYWETGSLIIGVSQVIWERLLPWSLWGKSPGVPVDSISLGHLGGGFFF

SEQ ID NO: 789174 - protein, 418 aa, Homo sapiens
MVSSFLAVLIFVKFADEFGASGNIETKELGKKKTNVTIMLLTTLLPAKLKVLSAPHPLPGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 789175 - protein, 418 aa, Homo sapiens; identical to SEQ ID NO: 789174

SEQ ID NO: 789176 - protein, 418 aa, Homo sapiens; identical to SEQ ID NO: 789174

SEQ ID NO: 789177 - protein, 418 aa, Homo sapiens; identical to SEQ ID NO: 789174

SEQ ID NO: 789178 - protein, 418 aa, Homo sapiens; identical to SEQ ID NO: 789174

SEQ ID NO: 789179 - protein, 418 aa, Homo sapiens; identical to SEQ ID NO: 789174

SEQ ID NO: 789180 - protein, 418 aa, Homo sapiens; identical to SEQ ID NO: 789174

SEQ ID NO: 789181 - protein, 418 aa, Homo sapiens; identical to SEQ ID NO: 789174

SEQ ID NO: 789182 - protein, 418 aa, Homo sapiens; identical to SEQ ID NO: 789174

SEQ ID NO: 789183 - protein, 418 aa, Homo sapiens; identical to SEQ ID NO: 789174

SEQ ID NO: 789184 - protein, 418 aa, Homo sapiens; identical to SEQ ID NO: 789174

SEQ ID NO: 789185 - protein, 418 aa, Homo sapiens; identical to SEQ ID NO: 789174

SEQ ID NO: 789186 - protein, 418 aa, Homo sapiens; identical to SEQ ID NO: 789174

SEQ ID NO: 789187 - protein, 418 aa, Homo sapiens; identical to SEQ ID NO: 789174

SEQ ID NO: 789188 - protein, 123 aa, Homo sapiens
MDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 789189 - protein, 123 aa, Homo sapiens; identical to SEQ ID NO: 789188

SEQ ID NO: 789190 - protein, 345 aa, Homo sapiens
VPAQTSFSTSSHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 789191 - protein, 305 aa, Homo sapiens
MFLFVSPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 789192 - protein, 246 aa, Homo sapiens [sequence omitted]

SEQ ID NO: 789193 - protein, 112 aa, Homo sapiens
MDVEPRAKGVLLEPFVHQVGGHSCVLRFNETTLCKPLVPREHQFYETLPAPSFLCSDLFLFFNIFSEFLPPSFAQAHVFLYFFPFIGTSAGSVWRCTFCSVCSAYGMLLIFA

SEQ ID NO: 789194 - protein, 162 aa, Homo sapiens
SLIKLIFPPPPGNAEEPGCGGSRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGQSQRPLVSWPSLPHFFPWSFPLWPQGSVA

SEQ ID NO: 789195 - protein, 150 aa, Homo sapiens; identical to SEQ ID NO: 789171

SEQ ID NO: 789196 - protein, 112 aa, Homo sapiens
AGGAGGGARPGRSHFGARETIGRKRRGTRLRRQQSILARTSQGAKTRGTHGQTTDRRRTGRWTPLPPPSPRHLRPEDEPSLQGHGCGAPRQRRPSGALCPPGRGALMRAPLQ

SEQ ID NO: 789197 - protein, 418 aa, Homo sapiens; identical to SEQ ID NO: 789174

SEQ ID NO: 789198 - protein, 418 aa, Homo sapiens; identical to SEQ ID NO: 789174

SEQ ID NO: 789199 - protein, 418 aa, Homo sapiens; identical to SEQ ID NO: 789174

SEQ ID NO: 789200 - protein, 418 aa, Homo sapiens; identical to SEQ ID NO: 789174

SEQ ID NO: 789201 - protein, 400 aa, Homo sapiens
MVSSFLAVLIFVKFADEFGASGNIETKELGKKKTNVTIMLLTTLLPAKLKVLSAPHPLPGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 789202 - protein, 123 aa, Homo sapiens; identical to SEQ ID NO: 789188

SEQ ID NO: 789203 - protein, 123 aa, Homo sapiens; identical to SEQ ID NO: 789188

SEQ ID NO: 789204 - protein, 123 aa, Homo sapiens; identical to SEQ ID NO: 789188

SEQ ID NO: 789205 - protein, 249 aa, Homo sapiens
IESVPGPMQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 789206 - protein, 129 aa, Homo sapiens
MAWVKFLRKPGGNLGKVYQPGSMLSLAPTKGLLNEPGQNSCFLNSAVQVLWQLDIFRRSLRVLTGHVCQGDACIFCALKTIFAQFQHSREKALPSDNIRHALAESFKDEQRFQLGLMDDAAECFVSVSD

SEQ ID NO: 789207 - protein, 106 aa, Homo sapiens
TPHGNIGQKFQGGNADRIDPTNERWKMVHRYFNFFISLEGQFWSIFYNNFSGIHSVIKFQLPMVVICSLIHPLLAFSLPYCLSSLLPQAPKHLPKKVFTPKSLSLG

SEQ ID NO: 789208 - protein, 80 aa, Homo sapiens
GARCPGWTCVHHDGELGQSHQESGTPLSPARRAVRMARAGSAPFGDKPEQRSRELTPAMQPCWERGAPCIPQFRGPYYLP

SEQ ID NO: 789209 - protein, 101 aa, Homo sapiens
LGGAEQCRYPHAGGREPQGPEQGEKVTHSHAGGRGVVQADEVRMWRKGHSFPPRADLVQDVRAVRPLGVGWGYMQKRRQQEKTSYLQGVDLISRYIKDTGC

SEQ ID NO: 789210 - protein, 76 aa, Homo sapiens
EPRGHGPVMSQGGVTAGTNPDPQRGILPAASDHRLPGRWLTTAASRCAPGKPNGRTARANERPVRSREERDLPRVF

SEQ ID NO: 789211 - protein, 107 aa, Homo sapiens
FLALGFLALVPWTFGAGSPSVVGPSWALQDIEQHPWPPYPGCRDYSHAPAVTTRNVSIGCQGSPGSPRTVLVLALKAPLAGKPLGPGQAGTAGHPPWGVTLPPALLH

SEQ ID NO: 789212 - protein, 126 aa, Homo sapiens
RIPSEMSAFEKHNPKVEDLQGTLFSHFCLHGGHCPLGRPGWLLAQVSPIFLGTCGIASRPEGAAGSVGSSLTQGAQLGCPLPMAGVMATSPWFMHEASSPFQLREHMQNDSHPADWKLPPLQKSGS

SEQ ID NO: 789213 - protein, 86 aa, Homo sapiens
NQRMRQLKTLHVEAPTGTTAARLQRREMDLRNLLVSGFLYENLYHTNKQMNTQTKQAQDLNSIRVSGDKHNISKCHIVTNTSMPSC

SEQ ID NO: 789214 - protein, 87 aa, Homo sapiens
MGHRLRLKSGKIKAMVEKPNKMTETRRRALRVQCLRTDCTGGALGARPYLNADPGTAAVRPQRNNTGKRRMCTILKKNYYKSPNLVR

SEQ ID NO: 789215 - protein, 140 aa, Homo sapiens
FQPSVRSLYQVLASVKNKIEQFASVERDFPGLLIQAQQYLLFRVDMSDMTPAALTKDPIQEASRTGSGKNLLDGPPRVLQPFLTHRTKVAEAPPNLPLPVRNPMLAAALFPEFLKELAALAQEHSILCYKILGDFEDSCC

SEQ ID NO: 789216 - protein, 98 aa, Homo sapiens
IESSCVLDPARLTKDPIQEASRTGSGKNLLDGPPRVLQPFLTHRTKVAEAPPNLPLPVRNPMLAAALFPEFLKELAALAQEHSILCYKILGDFEDSCC

SEQ ID NO: 789217 - protein, 96 aa, Homo sapiens
NSSWYRLPTLTKDPIQEASRTGSGKNLLDGPPRVLQPFLTHRTKVAEAPPNLPLPVRNPMLAAALFPEFLKELAALAQEHSILCYKILGDFEDSCC

SEQ ID NO: 789218 - protein, 110 aa, Homo sapiens
MRLKATDTRQREVYSGGHSDGDNPTPQSIRESTEGYPGKRKLLRLIHRYSSVEGLEPLMFCLSPEVRGLEHQWILGRAKTKTRGTRLWRSRAESAAGLTLGMAHHSINPC

SEQ ID NO: 789219 - protein, 87 aa, Homo sapiens
KLPRLSRIPVSALYVGALLCLVQRFGEDICRNWRALYSLRGNMHLGREAADQLSWSCSPKAVWLVGAPQAGRQHPSSELLSLAVWWQ

SEQ ID NO: 789220 - protein, 106 aa, Homo sapiens
SQKSFPSLKVWSIQGQEMAEWNFHVSAGTSALQIGHSGALFSGPEGAQNPCPSSHVADGDTEDQSLAQGHQVITNGVFRWNLKKGGGKRVGLEAVPSLNLSSTVSK

SEQ ID NO: 789221 - protein, 116 aa, Homo sapiens
NKDQKLLHQLGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKV

SEQ ID NO: 789222 - protein, 114 aa, Homo sapiens
SRKGVHLGSGCSWTLLTLKVLILCCLENQEVLRDKQMASGQVPAKSARTWEPTTYSVGRGALLPLRTHAHLLLGWPSPGRAALLFAQCFLPKLISVVPFSDGWTLVASYSLCRI

SEQ ID NO: 789223 - protein, 73 aa, Homo sapiens
FIAALSTHSCSTQLRCTHKSKLVCVSLYPDKTPQGADQVLVILASPKLGPACAYQVSEKWLLEQNRGRSSGGD

SEQ ID NO: 789224 - protein, 110 aa, Homo sapiens
MQPGMGTVVLLVARPPCLPSQSTLVPGGSPAIPRRLGSITVIYHMVIAGDAERSPQTSCTFDVHADSVRQVLFSSRFTDEEPETQLQAPQQPVLGCPNPSALVQTKWISV

SEQ ID NO: 789225 - protein, 40 aa, Homo sapiens
MTSALAILLSHTAQSILCLLSSPRPHKLFSLSGMFFFTKH

SEQ ID NO: 789226 - protein, 101 aa, Homo sapiens
PHSSESTIPSGFRAIPPNAQEARHWGLLQVRVSRKHGREPQLDCVLGVSTQNWSFQGLKQGTFFWGQELTLGKSYKNPRQEEGPGHLLPDMKDTHALSRDL

SEQ ID NO: 789227 - protein, 383 aa, Homo sapiens
LPALGRANPASAPIYARKIRVQVRWGGGRWDVLLRVRREEGSHGLRAGGWRARAECSACLETFGRTSAGTPTAQRRPGASHCGPARAWAFATRYGVVQTTCGPRTATTARGSSTAARSARPARVSSASAGPLRRRTSRSESLVLLAPPGPYPGAACFDVWDQSLEMVETTLPRLRSRSRLGSRLPPNRMHNLEENFCQTQMGIAMGPGATRWTQGPHSTTVPCDAALMTSRHQSWTPPDQVQFEKCGKRVDRLDQRCSNCAWLGAIRATHPGQSACGIGEAQLPVSHREELRQGQHFCGGSLVKEQWILTARQCFSSCHMPLTGYEVWLGTLFQNPQHGEPGLQRVPVAKMLCGPSGSQLVLLKLERSVTLNQRVALICLPPE

SEQ ID NO: 789228 - protein, 154 aa, Homo sapiens
MPLTGYEVWLGTLFQNPQHGEPGLQRVPVAKMLCGPSGSQLVLLKLERSVTLNQRVALICLPPEWYVVPPGTKCEIAGRGETKGTGNDTVLNVALLNVISNQECNIKHRGHVRESEMCTEGLLAPVGACEGDYGGPLACFTHNCWVLKGIRIPN

SEQ ID NO: 789229 - protein, 416 aa, Homo sapiens
LPALGRANPASAPIYARKIRVQVRWGGGRWDVLLRVRREEGSHGLRAGGWRARAECSACLETFGRTSAGTPTAQRRPGASHCGPARAWAFATRYGVVQTTCGPRVRPKLGGYRAGAGSLEPRAGARSRPDGCPHRPQTATTARGSSTAARSARPARVSSASAGPLRRRTSRSESLVLLAPPGPYPGAACFDVWDQSLEMVETTLPRLRSRSRLGSRLPPNRMHNLEENFCQTQMGIAMGPGATRWTQGPHSTTVPCDAALMTSRHQSWTPPDQVQFEKCGKRVDRLDQRCSNCAWLGAIRATHPGQSACGIGEAQLPVSHREELRQGQHFCGGSLVKEQWILTARQCFSSCHMPLTGYEVWLGTLFQNPQHGEPGLQRVPVAKMLCGPSGSQLVLLKLERSVTLNQRVALICLPPE

SEQ ID NO: 789230 - protein, 312 aa, Homo sapiens
LPALGRANPASAPIYARKIRVQVRWGGGRWDVLLRVRREEGSHGLRAGGWRARAECSACLETFGRTSAGTPTAQRRPGASHCGPARAWAFATRYGVVQTTCGPRVRPKLGGYRAGAGSLEPRAGARSRPDGCPHRPQTATTARGSSTAARSARPARVSSASAGPLRRRTSRSESLVLLAPPGPYPGAACFDVWDQSLEMVETTLPRLRSRSRLGSRLPPNRMHNLEENFCQTQMGIAMGPGATRWTQGPHSTTVPCDAALMTSRHQSWTPPDQVQFEKCGKRVDRLDQRCSKLRVAGGHPGNSPWTVSLRNW

SEQ ID NO: 789231 - protein, 102 aa, Homo sapiens
PGESSLLLKSLVPVGNTWENMTPLGASGAECRNRNVTLPTHGHLLPISPCIDAQDFLRFLSAQHSHNLVGQLHSRNLRKERQMAARLKDTAHPSSMSVLAPG

SEQ ID NO: 789232 - protein, 232 aa, Homo sapiens
SFPGLLFLSRKAGVLPRDAPARTSSQEGLGSLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFKGEKKKKNLKKMKKKKKMGKKKKVKKKNVKKGKKSLQL

SEQ ID NO: 789233 - protein, 105 aa, Homo sapiens
WIIGRDHHVRLIFVFLIELGFLHVGQAGLELLISSDLQASASQSAGITAMSHCARPLTCFSEDKGFLGSSCPPHLHLCTFYQPKFAWVKNSQKLTTLNKTCFGVV

SEQ ID NO: 789234 - protein, 34 aa, Homo sapiens
ISILQQIELDLKATQALVLAPTRELAQQIQKVVM

SEQ ID NO: 789235 - protein, 159 aa, Homo sapiens
AATEFVPYLGLCSWALIWVEGRSLAPVYRHSGSQPNLPQGLPEALGSYRPGSEAPHGLQLAGMLGESLPACGLCTPACRMGVQKHLLIKCSGGLSEPMPRACPPWGMPRTPTLPSKFGFGRVPSCLQLCLLSERRSCSACPPKQRGWKCVGVRRTYPVR

SEQ ID NO: 789236 - protein, 47 aa, Homo sapiens
LNLVSSSLILLSHCTFSVGNILPVIFGSFFYITTINNGATQCFCQAY

SEQ ID NO: 789237 - protein, 186 aa, Homo sapiens
RQGWTRRGGRQDGGAGAKAEGADTGGVWRSIKGLRGPRSLLGGQRPPARNTARCRFSASRAQCWQAAPLWSPLGHWPCTSRSLRLREAHGEPEAGGYPPASPRRLVPAGAAFLRGARGDPRPAAPLPLRATWDGTSGPLLPTLLPQDICVLTAQSREALSSYTHSQRHCLLHWKWSPSRLLSDLLC

SEQ ID NO: 789238 - protein, 128 aa, Homo sapiens
HQRSPCFRSSDLLLWALLGVMLFIPFHFQTSCVLTLNSSSFFPLLCLICALISSQSFGLFSSPILLDLSASVTFYPHLSGNFSFHFLNVVIHLGLGPWAPSLPLSSLMGARRILLPSGCGAFLSFKDA

SEQ ID NO: 789239 - protein, 63 aa, Homo sapiens
HLYLKFNYLSSQLLPHEFTTSYITCTATPSSQIIFYLHSGPISHSSTLLNKSNYDTILRKILL

SEQ ID NO: 789240 - protein, 79 aa, Homo sapiens
ADEPGPGAPAPQELGAADKHGDLCEVSLTSSAQGEAREDPLLDKPTAQPIVQDHQEHPGLGSNCCVPLLCWAWLPRRRR

SEQ ID NO: 789241 - protein, 85 aa, Homo sapiens
GLPKCWDYRHEPPRPANDSNLFSNSSGAWKSKIKASAGPYSLQKLKGRLLSASSRCWWLQAFLGLRLQPSNLCLCLPVVHVVLLS

SEQ ID NO: 789242 - protein, 107 aa, Homo sapiens
FYCVLWNPWHMLNNFSCIFSFTTGGFCQLSLNLKLNLSSQKTILPPSLSNGCCSMYHTSSREVGLATSSVPDAASRSLNAVYLPHVVTIVYFQSLCYFRSFIKVSEN

SEQ ID NO: 789243 - protein, 134 aa, Homo sapiens
GILLHLEIVTPLLVYTRGVLLNQEVVTPLLVYTRGILLHQEMVTLPPGLYPWGCSSIRRWSLPSWSIPVGFSSLRRWSLPLLVYTHGILLPQKMVTPPPGLYPWGCSSIRRWSLSLSVAQSKNNLSGKLRGIFF

SEQ ID NO: 789244 - protein, 136 aa, Homo sapiens; identical to SEQ ID NO: 741065

SEQ ID NO: 789245 - protein, 226 aa, Homo sapiens
EQECRNGSLYVRDNTGVLSCELIDLDLSWLGHLFLFPRWSYLPPARWNSSGEGHLELWDAPVPVFPLTISPGPVTPIPVLYPESASCLLRLRNKLRGVQRNLAGSLVRLSALVKSKQKAYFILSLGRSHPAVTHVSIIVQVPAQLVWHRALRPGTAYVLTELRVSKIRGQRQHVWMTSQSSRLLLLKPECVQELELELEGPLLEADPKPLPMPSNSEDKKDPESLV

SEQ ID NO: 789246 - protein, 162 aa, Homo sapiens
RQRLPESTVSLCQTRLKKEHYFILIKQVYAATRTMESTLTLATEQPVKKNTLKKYKIACIVLLALLVIMSLGLGLGLGLRKLEKQGSCRKKCFDASFRGLENCRCDVACKDRGDCCWDFEDTCVESTRIWMCTRYRCGETRLEASLCLVQMTVAQERLLADY

SEQ ID NO: 789247 - protein, 76 aa, Homo sapiens
FISCSCTLRLTTIYAPRLLRITHRMCRSPTLHLEPASVYASPHVAARLLVNVSSLPFQPSQSCVSLKVQPESFLPL

SEQ ID NO: 789248 - protein, 76 aa, Homo sapiens; identical to SEQ ID NO: 789247

SEQ ID NO: 789249 - protein, 71 aa, Homo sapiens
RLLLDLVPYVAADSSEPQRTCRSPTLHLEPASVYASPHVAARLLVNVSSLPFQPSQSCVSLKVQPESFLPL

SEQ ID NO: 789250 - protein, 54 aa, Homo sapiens
VNMEDFIASESGSQQEGELARGWSWKVIFPKSSHLQLDSSPKQHHQAAPLKSSC

SEQ ID NO: 789251 - protein, 71 aa, Homo sapiens
GWNTYSMHTCSSCFFGNRAIITKVELEVASIFSWGYFFTILHAEVGNASPGAGLAVPSGLTGSGPHRMGGD

SEQ ID NO: 789252 - protein, 110 aa, Homo sapiens
IIGLKGEPCSGYYHSICTFSVQMKINAVFPSVLKGYEHPGYEHPGYPGSLHVDTNIEASSHSCFKPCLPEKQNVLNRGENWQSCPLCSPGHSGHWELNTLHLYLQLYQLM

SEQ ID NO: 789253 - protein, 101 aa, Homo sapiens
NISDFTQERLPLHVLNVENSLCAKMILLHIREFTQERNRTNAVTAGKPSLQNQGSMFIKENIQERGPMDVVIVGKLLRTCLSLLNTGEFTGSHFGKASCQM

SEQ ID NO: 789254 - protein, 101 aa, Homo sapiens; identical to SEQ ID NO: 789253

SEQ ID NO: 789255 - protein, 235 aa, Homo sapiens
WDFNHDDDSKQPDSLGSPNACALPMSLRPPALPILILISLSNFLPLLSPKPRSFSPQGLCWCPAPCLACSGSPISFNYPFLKIHLFWEALPPDFIVPFPELMSCCLLLRKPTRGVYVDLVHSLIVSWERHMRYACALPTLCRSQRMCRSQRMCRSHVPLLVLTQLPRHVLLGPLQGGLQLGQLGVGILNGQLFTLLGICNGGLQETLWPLRPLNLGWTRLMFRVNSKNLIFGRPK

SEQ ID NO: 789256 - protein, 99 aa, Homo sapiens
WDFNHDDDSKQPDSLGSPNACALPMSLRPPALPILILISLSNFLPLLSPKPRSFSPQGLCWCPAPCLACSGSPISFNYPFLKIHLFWEALPPDFTCSLP

SEQ ID NO: 789257 - protein, 294 aa, Homo sapiens
TAEGENDAQVGLPGPPAEERPALHTRRPSIRVKRRRERALPTSCDSWLPGDIRLSRDSRQAGAGAPTSEERCPGRSSPCSWASAATRLGSSSGNSCAPSNGISPEGIVEEFATEGTDRKDVFFYQADDEHYIPRAVLLDLEPRVIHYILNSPYAKLYNPENIYLLEHGGGAGNNWASGFSQGEKIHEDIFDIIDEKQMEVTVWQGFVLCHSIAGGTGSGLGSYLLERLNDRYPKKLVQTYSVFPYQDEMSDVVVQPYNSLLTLKRLTQNADCVVVLDNTALNRIATDRLHIQPF

SEQ ID NO: 789258 - protein, 303 aa, Homo sapiens
TAEGENDAQVGLPGPPAEERPALHTRRPSIRVKRRRERALPTSCDSWLPGDIRLSRDSRQAGAGAPTSEERCPGRSSPCSWASAATRLGSSSGNSCAPSNGISPEGIVEEFATEGTDRKDVFFYQADDEHYIPRAVLLDLEPRVIHYILNSPYAKLYNPENIYLLEHGGGAGNNWASGFSQGEKIHEDIFDIIDREADGSDSLELQNSSSSDQGFVLCHSIAGGTGSGLGSYLLERLNDRYPKKLVQTYSVFPYQDEMSDVVVQPYNSLLTLKRLTQNADCVVVLDNTALNRIATDRLHIQPF

SEQ ID NO: 789259 - protein, 45 aa, Homo sapiens
MIEQRRRTANEVVENLGQRGVPEVQSSGEIQSFRRGPIFRRVRFP

SEQ ID NO: 789260 - protein, 110 aa, Homo sapiens
HPLDNFSQCQCFKYSWPGPWISSLQQSSSKNSVFLPRIISWEYVVVLGLGECLSKIPSKHHALLNFSKWSLYCLFSEDFALLSWIPAGSFSLLQQNWFTWRTFFHVTLIS

SEQ ID NO: 789261 - protein, 92 aa, Homo sapiens
HLVKFICLGLWNLFLLLSLRILLFRRTFYPSNVSPVCYEDMGNNTANWWMLLRILPQSFGFIVPLRSCCSATDSPCIRCLRPIWGRSTGPCG

SEQ ID NO: 789262 - protein, 40 aa, Homo sapiens
SFLSKLPEHPGQKQAARSRATRVQSTDPRPWFSYQTGLAA

SEQ ID NO: 789263 - protein, 232 aa, Homo sapiens
MPRGHKSKLRTCEKRQETNGQPQGLTGPQATAEKQEESHSSSSSSRACLGDCRRSSDASIPQESQGVSPTGSPDAVVSYSKSDVAANGQDEKSPSTSHDVSVPQESQGASPTGSPDAGVSGSKYDVAAEGEDEESVSASQKAIIFKRLSKDAVKKKACTLAQFLQKKFEKKESILKADMLKCVRREYKPYFPQILNRTSQHLVVAFGVELKEMDSSGESYTLVSKLGLPSEG

SEQ ID NO: 789264 - protein, 260 aa, Homo sapiens
ASKNRLWRQQSARGRKPLRPGGAPARTRGLQRCPARKPILGVRAGPRGLRGSRVEGFGPRGCGAPLGAGPPAAVSASLHFPGGIPHLLNEGVEADTLGNGFELTTDFREWKEKPFLRRLPYHCMFQGPPWALCLPRHREHGLSGRAKARRRREPAVVGAGRVTAGWRGRGRWEALQKEEPPPSKFPSATHRRASPSAASIFFLCSPSPTNAGFPFSFVDFFPWILLTAPTLWPHVWQMRGGRCLNPRILTSLCAAATALS

SEQ ID NO: 789265 - protein, 115 aa, Homo sapiens
IGGIEVGLSHFPFFACLSSEFQLVSSILGFCYSDLVCCYHSDVGAAANFFGVFSPITMVKLLCDLEQASVTTGAPLFHLHKKVVVVVRDASICRAPHVHQGVHSQTGVFSFTPQK

SEQ ID NO: 789266 - protein, 218 aa, Homo sapiens
MTMPVNGAHKDADLWSSHDKMLAQPLKDSDVEVYNIIKKESNRQRVGLELIASENFASRAVLEALGSCLNNKYSEGYPGQRYYGGTEFIDELETLCQKRALQAYKLDPQCWGVNVQPYSGSPANFAVYTALVEPHGRIMGLDLPDGGHLTHGFMTDKKKISATSIFFESMPYKVNPDTGYINYDQLEENARLFHPKLIIAGTSCYSRNLEYARYGRLR

SEQ ID NO: 789267 - protein, 212 aa, Homo sapiens
MTMPVNGAHKDADLWSSHDKMLAQPLKDSDVEVYNIIKKESNRQRVGLELIASENFASRAVLEALGSCLNNKYSEGYPGQSWSAVVQSRLIAASNPWAQAILLPQPLCELGPQAPLQTLLVYTALVEPHGRIMGLDLPDGGHLTHGFMTDKKKISATSIFFESMPYKVNPDTGYINYDQLEENARLFHPKLIIAGTSCYSRNLEYARYGRLR

SEQ ID NO: 789268 - protein, 107 aa, Homo sapiens
SRVAEITDMRYHAWLIFVFLVEMRFRHAGQAGPQLLASSDLPALASQSARITGVSHCARPGSFIVCISVHFFPKKPHVFVGRTWNPIQLYSPASSTAPLQSLVPWTS

SEQ ID NO: 789269 - protein, 165 aa, Homo sapiens
RYHVTAVLALGAGSALLGTDVQVEAAPAALELVCPSSVQSDESLDLSIQNRGGSGLEAAYSIVALGEEPARAVHPLCPSDTEIFSGNGHCYRLVVEKAAWLQAQEQCRAWAGAALAMVDSPAVQRFLVSRVTRSLDVWIGFSTVQRVEVGPAPQGEAFSLESCQN

SEQ ID NO: 789270 - protein, 97 aa, Homo sapiens
AVLGLEIQEESLVISVIVEVDQGEDVMILDGVTMMVLAVMVTELALANLNGVDTVIGVTSQIKIIGQNHFHQVNAWSRYSFLEKTLGLTLRNMIIYQ

SEQ ID NO: 789271 - protein, 359 aa, Homo sapiens
MIAAQAKLVYHLNKYYNEKCQARKAAIAKTIREVCKVVSDVLKEVEVQEPRFISSLNEMDNRYEGLEVISPTEFEVVLYLNQMGVFNFVDDGSLPGCAVLKLSDGRKRSMSLWVEFITASGYLSARKIRSRFQTLVAQAVDKCSYRDVVKMVADTSEVKLRIRDRYVVQITPAFKCTGIWPRSAAHWPLPHIPWPGPNRVAEVKAEGFNLLSKECHSLAGKQSSAESDAWVLQFAEAENRLQMGGCRKKCLSILKTLRDRHLELPGQPLNNYHMKTLVSYECEKHPRESDWDESCLGDRLNGILLQLISCLQCRRCPHYFLPNLDLFQGKPHSALENAAKQTWRLAREILTNPKSLEKL

SEQ ID NO: 789272 - protein, 359 aa, Homo sapiens; identical to SEQ ID NO: 789271

SEQ ID NO: 789273 - protein, 359 aa, Homo sapiens; identical to SEQ ID NO: 789271

SEQ ID NO: 789274 - protein, 87 aa, Homo sapiens
SRGCDDGRIKWDGIIPVSCCIGIQIQYPRLHMPEIQIYSEIQWMANKCFLIEKRWKEREGREGEAREVLCGTVELGSGTSSERRGKV

SEQ ID NO: 789275 - protein, 221 aa, Homo sapiens
ACAPGSVLKGAKAQPVLGALCYSPPSGRPSRRWLFLLEQVSKVEAQTLSLLLRLRQMWVRGSWVVPSRHGGTWVWAPGTWGAVLAKQEGTGAQLLILPHSCSDVDECRTHNGGCQHRCVNTPGSYLCECKPGFRLHTDSRTCLAINSCALGNGGCQHHCVQLTITRHRCQCRPGFQLQEDGRHCVRECCQPGREDLGVEAGQAASPGLLGGSGSSGGPQGC

SEQ ID NO: 789276 - protein, 101 aa, Homo sapiens
QRARPCQARTWRMREVQLFSQVQTLEGPHVDSVASAPTHSREDTALPGRESAELGPCCSSLWHHPVSPSLSHICSARPAVKYLLSQTFVEWDEPWRFRQMP

SEQ ID NO: 789277 - protein, 356 aa, Homo sapiens
MPASSLPGKLWFVLTMLLRMLVIVLAGRPVYQDEQERFVCNTLQPGCANVCYDVFSPVSHLRFWLIQGVCVLLPSAVFSVYVLHRGATLAALGPRRCPDPREPASGQRRCPRPFGERGGLQVPDFSAGYIIHLLLRTLLEAAFGALHYFLFGFLAPKKFPCTRPPCTGVVDCYVSRPTEKSLLMLFLWAVSALSFLLGLADLVCSLRRRMRRRPGPPTSPSIRKQSGASGHAEGRRTDEEGGREEEGAPAPPGARAGGEGAGSPRRTSRVSGHTKIPDEDESEVTSSASEKLGRQPRGRPHREAAQDPRGSGSEEQPSAAPSRLAAPPSCSSLQPPDPPASSSGAPHLRARKSEWV

SEQ ID NO: 789278 - protein, 370 aa, Homo sapiens
MEGVDLLGFLIITLNCNVTMVGKLWFVLTMLLRMLVIVLAGRPVYQDEQERFVCNTLQPGCANVCYDVFSPVSHLRFWLIQGVCVLLPSAVFSVYVLHRGATLAALGPRRCPDPREPASGQRRCPRPFGERGGLQVPDFSAGYIIHLLLRTLLEAAFGALHYFLFGFLAPKKFPCTRPPCTGVVDCYVSRPTEKSLLMLFLWAVSALSFLLGLADLVCSLRRRMRRRPGPPTSPSIRKQSGASGHAEGRRTDEEGGREEEGAPAPPGARAGGEGAGSPRRTSRVSGHTKIPDEDESEVTSSASEKLGRQPRGRPHREAAQDPRGSGSEEQPSAAPSRLAAPPSCSSLQPPDPPASSSGAPHLRARKSEWV

SEQ ID NO: 789279 - protein, 315 aa, Homo sapiens
APPRDAARRNYFLLSPFFLPLLFPLLGSGCGGVGETLNDRARVHLSLHVDVPGNGHTDAMVTFATILQVNKVMSILFYVIFLAYLRGIQGNNMDQRSLPEDSLNSLIIKLIQADILKNKLSKQMVDVKENYQSTLPKAEAPREPERGEPAKSAFQPVIAMDTELLRQQRRYNSPRVLLSDSTPLEPPPLYLMEDYVGSPVVANRTSRRKRYAIKSHRGEYSVCDSESLWVTDKSSAIDIRGHQVTVLGEIKRATLPSNNIFMKRDVRKQAGQKRCRGIDDNSWNSQCKTSQTYVRALTSENNKLVGWRWIRITPV

SEQ ID NO: 789280 - protein, 74 aa, Homo sapiens
AWEAENILSRGNSMGEEGPVTCDLACSRWHSLLGGRLEAATEVKVPGWEAPGRLVQEFRLDTVESYPGGWNGRG

SEQ ID NO: 789281 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 789282 - protein, 177 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPVPGNRG

SEQ ID NO: 789283 - protein, 258 aa, Homo sapiens; identical to SEQ ID NO: 789281

SEQ ID NO: 789284 - protein, 277 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSACQPTPAWGEVAAAGLLPAL

SEQ ID NO: 789285 - protein, 103 aa, Homo sapiens [sequence omitted]

SEQ ID NO: 789286 - protein, 106 aa, Homo sapiens
GSRGCLHRPLRSSHLRLEGSVLMPYKRRVQEIGFQKKQWSPAWDYEDTKQLTLRDRVSLCCMRWNVVVILTDVVTACYSLGLLGSSHPPASASPCGGLQALPHAWL

SEQ ID NO: 789287 - protein, 255 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAM

SEQ ID NO: 789288 - protein, 70 aa, Homo sapiens
PLVCKRRKALLLPPARTRTLTPLDAGVMLESSPLLLAFLVLFLHFPFADFTDFESLTMEPLVSRDLRNRK

SEQ ID NO: 789289 - protein, 144 aa, Homo sapiens
LGLWLWPGRPCWPPLPPSVSGLRVAHLLCASCRPLIAPSCRVSLCSLPTLHTNLCHPYCCQPSFLPPGLSPYPQTLAPFLLHSSLPIPVRALTLCCHEPPSPPPRILTVVHLLPIPLLPPLCMFCQKYTCMEFLNAYSNKPAAL

SEQ ID NO: 789290 - protein, 95 aa, Homo sapiens
SGVVCVISPWISRPRQNSCRPRRHRGACAASFTGGSPVLGPGPFYGVQGFVTRALVPGPVTCVLEGGPFPASVYLLLCFLLGRHSNYNDSVTSST

SEQ ID NO: 789291 - protein, 39 aa, Homo sapiens
NRSSMWGEGLALTPSGLMLHANHLPMRGQGVTPYQELPP

SEQ ID NO: 789292 - protein, 106 aa, Homo sapiens
LSPQVGVQWRDHGSLQPWPPGLKQSSHLSLLSCWDYKHVPLHLGNFFIYCRDAVSLFSMSRRLVSNSWAKAILSPRPPKVLVLQVRATAHSFLRNHLKLLLKKSNI

SEQ ID NO: 789293 - protein, 171 aa, Homo sapiens
MEAPGPRALRTALCGGCCCLLLCAQLAVAGKGARGFGRGALIRLNIWPAVQGACKQLEVCEHCVEGDGARNLSSCVWEQCRPEEPGHCVAQSEVVKEGCSIYNRSEACPGKGVLAPKPSCMGLPSHSLPPRRKQPLSGGGFCSPIPGPGISSAFSSLRSPLLSLPISSSEN

SEQ ID NO: 789294 - protein, 78 aa, Homo sapiens
MNILSPERFLLLSVFSSCLLSSRPLKKLGGPWNIAVSSFSSAFPSSLRCQLSLMSLFDIAARTSLPAVSAVRHPFHKN

SEQ ID NO: 789295 - protein, 107 aa, Homo sapiens
DCPHLPDEKLRLGDIEESVEREMRFYYFTRLVSNSWAQAIFPCGLPKVMGLQGSFLSSPREPKKGGWLALHSSDLHSSLCVRSPVLDTGDRTVSQSDAGPALMEFMV

SEQ ID NO: 789296 - protein, 175 aa, Homo sapiens
MYSSGWPAGAAEPRHGRGRELAQALGCMHGAPSQLASLSLAHCSSLKVLQFLQLRQLSLSLLPELTDNGLVAVARGCPSLEHLALSHCSRLSDKGWAQAASSWPRLQHLNLSSCSQLIEQTLDAIGQACRQLRVLDVATCPGINMAAVRRFQAQLPQVSCVQSRFVGGADLTLTL

SEQ ID NO: 789297 - protein, 104 aa, Homo sapiens
MAESLPLEMLTYILSFLPLSDQKEASLVSWAWYRAAQNALREVRHPPSPVPSSGVSYFSLLVALLMYLHPSIHPSIHPFICSYIHIYTYIHTYLALGTVLGLYR

SEQ ID NO: 789298 - protein, 223 aa, Homo sapiens
MYSSGWPAGAAEPRHGRGRELAQALGCMHGAPSQLASLSLAHCSSLKSRPELEHQASGTKDACPEPQGPSLLTLRALQELDLTACSKLTDASLAKVLQFLQLRQLSLSLLPELTDNGLVAVARGCPSLEHLALSHCSRLSDKGWAQAASSWPRLQHLNLSSCSQLIEQTLDAIGQACRQLRVLDVATCPGINMAAVRRFQAQLPQVSCVQSRFVGGADLTLTL

SEQ ID NO: 789299 - protein, 223 aa, Homo sapiens; identical to SEQ ID NO: 789298

SEQ ID NO: 789300 - protein, 122 aa, Homo sapiens
MGTAGVGPPARLPGPGRPSLTRPRGSTLCPLLGSARTPVLVDSSLSFLEEIISCDPLGWVHSRGWTVGGTSPSPLSPNRGLLVPLTQREPAIKGIPQVRLAGVGKPGPQRPQQGGRREHGAQ

SEQ ID NO: 789301 - protein, 79 aa, Homo sapiens
MNAEGGCTPVELPRGRTQSQPQPCLGSLGLAPGSCSYRVTRVNCWPPAIPTPRVSKVLGLNETAQIRHPWVHGTRKAPQ

SEQ ID NO: 789302 - protein, 104 aa, Homo sapiens
LFPPTPVPKFHCIILAPLCTQITSRLNCLLNNPIVKISILPEMSQKNNFVTIFKSVKATRGGKNTVNFSSIKFEVAVKKCEIINILGFSTDFYIHNCRIKIKIQ

SEQ ID NO: 789303 - protein, 36 aa, Homo sapiens
LLIYRVLSRSPYSPPGIQGSQPREGKRQLHARYWAQ

SEQ ID NO: 789304 - protein, 105 aa, Homo sapiens
GSGAVSCPPGSSKAWSSDAGSGGFWGAEAGSRGAVAAPGRRGGCAQKPALASGGRARGAGREFPCPPVRPATGLSWALTTARPCFALAALLCPQNAFPASPALQR

SEQ ID NO: 789305 - protein, 103 aa, Homo sapiens
CAEASQLQLPHSPTHPRLALNLLSPEENEDRKNSTYFQGKGGHAPQRLQEPRPLGAHLPQLSIGPTVEARRFRPSEHSSLSTPAGPYQSKTMSHKIIIILKKW

SEQ ID NO: 789306 - protein, 105 aa, Homo sapiens
QRIFLNAKHIAIASPLSSTQWKKVSTYWRTFLVRQHRGSSRVGVGGALPMQGEGKNLSTQRLLKASSQEKLLSPSVPLWEHPHSLCRSRPTVWHTCFLFMVLLQK

SEQ ID NO: 789307 - protein, 55 aa, Homo sapiens
AETIAQSSRNASGLECGASVPNAAPPPDCVALKKAQPLYLPAQRARSPAQLPSVC

SEQ ID NO: 789308 - protein, 141 aa, Homo sapiens
APLQRRSHNPTSSRSAAFPAPQARDRLRGRRAIPYLGVEIMWGLSAVCHRLQSRGAVGCVTWRSAGAGRTPGRGWGRGDLGSRCHCSRHWPGIMSLLLRKLAVGQRLSIRFPPLALPCARKAWPSATVPAAGAPDLFQGLL

SEQ ID NO: 789309 - protein, 170 aa, Homo sapiens
MSLSPRPGRNKNRRPLHKLASAKAAQLFLYLGGAAFCRDLSVHGLQSLGFSGSVKIYVFFPSPQSHFTQPLLLAAAPSGVCRISVLAGNVFSPHRAGYKLCRRGLFFGMKAGPLGLLARPRWVVDITRLLCGVERLSRSPGVLTQFIEARRSKPQSHLSWPKCAAILPEI

SEQ ID NO: 789310 - protein, 145 aa, Homo sapiens
AHGPRGAPAASLSAPGRRASRREGGAPVRAEIDAHTRRASSAAGREAAACGAGTAGRAPSAGVARPSAFRSADRSPVRRLQLLGRPPHPLAHSRPLQLEGVSAPPPSPRGPRWKAHAPHATPPRAPAPLRGFSTLRPEVGWETAN

SEQ ID NO: 789311 - protein, 221 aa, Homo sapiens
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTYRTVLRPKYKVGYKTVTDLAWRCCPGFTGKRCPEHLTDHGAASPQLEPEPQIPSGQLDPGPRPPSYSRAAPSPHGRKGPGLFGERLERLEGDVQRLAQTYGTLSGLVASHEDPNRMTGGPRAPA

SEQ ID NO: 789312 - protein, 62 aa, Homo sapiens
MIDLWLYSYQRLLQTIAVLEAQRSQAVQDLESLGRHQREALKNPIGFVEKLQKKADIGLPYP

SEQ ID NO: 789313 - protein, 293 aa, Homo sapiens
MNQKVNPFSSATVHPLPSPGQGPSGVCTLPQAHFFFCAPLHPTQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 789314 - protein, 539 aa, Homo sapiens
ELPRCPHSPSASSLGTRTDGLTDSRADSAASGARALGVDGQPQPSPPRRAPPRPVGADGSSRGPQPGRRRVERRGPATQPGDSRALPEPRGVPAVHPAGSGSEWERPPPAAPSPEHRDKMLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 789315 - protein, 33 aa, Homo sapiens
MEWNGMEWNGIEWNGMQWNGINRVQSNGIEWNG

SEQ ID NO: 789316 - protein, 272 aa, Homo sapiens
FLQTLRGSHSLPHLCPCAGCGWDPVFPAPRGTWFLCPGFCHSVTYAMPCCSHRRCREDPGTSESQEMDPVAFDDVAVNFTQEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKPCKCQQPKKAFRYHPSFRTPQRDHTGEKPYACKECGKTFISHSSIQRHVVMHSGDGPYKCKFCG

SEQ ID NO: 789317 - protein, 235 aa, Homo sapiens
FLQTLRGSHSLPHLCPCAGCGWDPVFPAPRGTWFLCPGFCHSVTYAMPCCSHRRCREDPGTSESQEMDPVAFDDVAVNFTQEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKPYTNLTLSPRLECSGRDLRSLQPLAPG

SEQ ID NO: 789318 - protein, 122 aa, Homo sapiens
RALPPHPTPLLPLDPALMTLTLAAAAGGSPRRAALGPTSLWLGPEHSAASAGPGLFSAALLPQGLSVPHSYPGRAALSWVLYGGPFPSVPETLILGFLPLNTDILKPNETSRSLHLILPPTP

SEQ ID NO: 789319 - protein, 135 aa, Homo sapiens
RFQVTRMKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 789320 - protein, 127 aa, Homo sapiens
SNASVILEGEDLRFSCSVRMAGRLQGRFSVIWQLVDRQNRRSDIMWLDRDGTVQPGSSYWERSSFGSVQMEQVQPNSFSLGIFNSRKEDEGQYECHVTEWVRVVDGEWQIVGERRASTPISIIALGE

SEQ ID NO: 789321 - protein, 68 aa, Homo sapiens
QERAAHSGDWDRISTRVDLSHWKYLVLLLEGGLQVLVILLRCCSKTMLVTVLNCKCQYPSPPKQRAYH

SEQ ID NO: 789322 - protein, 105 aa, Homo sapiens
SLVWPGRLSTLISEKQMGQRGKGRGGDPQEKGSGWETQPSSADRVGAEAQALPEETPLTGACQSTVRPTRLRAVSIGAGTMQRRPTHPWGEVRPNSNAARASGFL

SEQ ID NO: 789323 - protein, 80 aa, Homo sapiens
TAYLLQGEIYSEDTEQYFNQVIKININKLIIRKSQTNPNWKTFYQKPHTQTQINDYFCYGQLIFMANKHFLKAEIIYHTI

SEQ ID NO: 789324 - protein, 187 aa, Homo sapiens
PIARSCKRAPGAFPGARRCVRAPFCCSRGGGGPRGRRGGGCGRPARGRRPPSKPPAKCSGWQKQAAGSAEQAARPGAEQARGAAGQHHGCLRAPVPSARGWSSPCPCGAGPPGTSGSPACPRLDALGLAAAGAQGFESGPREGVRLGRPRSGGPVANMLRKGCCVELLLLLVAADCPWVVAAHGTVC

SEQ ID NO: 789325 - protein, 412 aa, Homo sapiens
MTLRRRGEKATISIQEHMAIDVCPGPIRPIKQISDYFPRFPRGLPPDAGPRAAAPPDAPARPAVAGAGRRSPSDGAREDDEDVDQLFGAYGSSPGPSPGPSPARPPAKPPEDEPDADGYESDDCTALGTLDFSLLYDQENNALHCTITKAKGLKPMDHNGLADPYVKLHLLPGASKANKLRTKTLRNTLNPTWNETLTYYGITDEDMIRKTLRISVCDEDKFRHNEFIGETRVPLKKLKPNHTKTFSICLEKQLPVDKTEDKSLEERGRILISLKYSSQKQGLLVGIVRCAHLAAMDANGYSDPYVKTYLRPDVDKKSKHKTAVKKKTLNPEFNEEFCYEIKHGDLAKKSLEVTVWDYDIGKSNDFIGGVVLGIHAKGERLKHWFDCLKNKDKRIERWHTLTSELPGAVLSD

SEQ ID NO: 789326 - protein, 111 aa, Homo sapiens
MRPGWDLCPPLSAAALGTLDFSLLYDQENNALHCTITKAKVGPASLPPNSLPRGPQEGLGQGGQTTPLPRFLSRLLDVCAVWGAGPGRNSSLNLLEYPTPRNALDSQALRG

SEQ ID NO: 789327 - protein, 184 aa, Homo sapiens
MTLRRRGEKATISIQEHMAIDVCPGPIRPIKQISDYFPRFPRGLPPDAGPRAAAPPDAPARPAVAGAGRRSPSDGAREDDEDVDQLFGAYGSSPGPSPGPSPARPPAKPPEDEPDADGYESDDCTALGTLDFSLLYDQENNALHCTITKAKGLKPMDHNGLADPYVKLHLLPGASKDFSEHLTC

SEQ ID NO: 789328 - protein, 102 aa, Homo sapiens
MAGWGGWSETVGRGRTKPQTQGSWGTPGKLLAGLVGCRAGGREVLRGVLGSSWRQQGKEGVRKMGRNSVWGKGTRDTLGPQEVFRPRRQVQLEMRIPPKEQE

SEQ ID NO: 789329 - protein, 246 aa, Homo sapiens
EAGASGQWVGVPAPGQARGGPALPLPLGVQAHRQAPRSRSCFANSPLAPPVPAAGLASPPPAGGVAGALAAAAERQHPQERRPGLCSRRPPSALRGRPPPRRPSARGGSRRRRPGALHLPRASGRAGAREKRRKKRAPREPHSLGSLGAEKRRPLTPRAPVLRAPGPQVEERHPSKGTSPRGEHSGLTDPGPPAGLQAPLLPAPRDPSRDPGDSRPAPGVPLGQHAMPGLRRDRLLTLLLLGALLS

SEQ ID NO: 789330 - protein, 93 aa, Homo sapiens
SSHQQIRKLIKDGLIIGKPVMVHSQAPCQKNTLASRKGRHTGIGKRKGTANVRMPEVTWIRRMRILCWLLRRYRESKKIDRHMYHSLYLMGEG

SEQ ID NO: 789331 - protein, 115 aa, Homo sapiens [sequence omitted]

SEQ ID NO: 789332 - protein, 110 aa, Homo sapiens
RHAGELWKSAMPASHLELQVMLGSWKGCARLSVESPTQRAMQEAERSLGEERGLATPNGTIRGVNSLFANTTRTPLPIKAELDPNPDSIHVRTVIFSRSGLQLQSACLYR

SEQ ID NO: 789333 - protein, 74 aa, Homo sapiens
VSKNGAKTAEEGGGGERGAKSRQGGSDKRERGTEGRGEILAVFFRSEIILDNFLFFSCKEMTLSEPFLEASKYH

SEQ ID NO: 789334 - protein, 280 aa, Homo sapiens
HLSPELAAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRSRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRNPWSCVCRALDPR

SEQ ID NO: 789335 - protein, 181 aa, Homo sapiens
RCARRPRRRRSRRGPDAPKQRPAEPRATPLCALARRLSAPRPERVVGRARGAARGGRRRQHQQLPEFPLRVLGLRHAALGLAGLRVLGPPAPPHGRQAGQAALRGRSTKDARLRPARRHAPPLPGVRGRWPQRLSSGSSQLALSQGRRLPRTTALGTACPGPSEVGPGELSDIPSLGLGSE

SEQ ID NO: 789336 - protein, 181 aa, Homo sapiens; identical to SEQ ID NO: 789335

SEQ ID NO: 789337 - protein, 181 aa, Homo sapiens; identical to SEQ ID NO: 789335

SEQ ID NO: 789338 - protein, 151 aa, Homo sapiens
RIRKEAKRNRRVLSRASRVLTLQQARDVGCPLQHSAGRCWGIQTAKANLRPQNNCVWPRGVGKNSNRERPSLAYLQTGRKLLVLHVNKHAQFKLELFKFWKTAHHIQPRGGAAEQQGAQKSHSSLQFLPTALSKYTHFQDCFQIQVSTGHC

SEQ ID NO: 789339 - protein, 588 aa, Homo sapiens
MASKKREVQLQTVINNQSLWDEMLQNKGLTVIDVYQAWCGPCRAMQPLFRKLKNELNEDEILHFAVAEADNIVTLQPFRDKCEPVFLFSVNGKIIEKIQGANAPLVNKKVINLIDEERKIAAGEMARPQYPEIPLVDSDSEVSEESPCESVQELYSIAIIKPDAVISKKVLEIKRKITKAGFIIEAEHKTVLTEEQVVNFYSRIADQCDFEEFVSFMTSGLSYILVVSQGSKHNPPSEETEPQTDTEPNERSEDQPEVEAQVTPGMMKNKQDSLQEYLERQHLAQLCDIEEDAANVAKFMDAFFPDFKKMKSMKLEKTLALLRPNLFHERKDDVLRIIKDEDFKILEQRQVVLSEKEAQALCKEYENEDYFNKLIENMTSGPSLALVLLRDNGLQYWKQLLGPRTVEEAIEYFPESLCAQFAMDSLPVNQLYGSDSLETAEREIQHFFPLQSTLGLIKPHATSEQREQILKIVKEAGFDLTQVKKMFLTPEQIEKIYPKVTGKDFYKDLLEMLSVGPSMVMILTKWNAVAEWRRLMGPTDPEEAKLLSPDSIRAQFGISKLKNIVHGASNAYEAKEVVNRLFEDPEEN

SEQ ID NO: 789340 - protein, 135 aa, Homo sapiens
MDPGEFLLGLKGITQIAETWLSGSGRNPTSNKNGNFPQGKFPGFYGKAHLSSQGQPLFTCPRGRFEARYGRQSNAVFEDWKIRGCEIPPGPTPAQQLPKQTLCTRLPQAHPFAVHARARTHTHTSTHTRSCGSGV

SEQ ID NO: 789341 - protein, 104 aa, Homo sapiens [sequence omitted]

SEQ ID NO: 789342 - protein, 187 aa, Homo sapiens
MESKVSEGGLNVTLTIRLLMHGKEVGSIIGKKGETVKKMREESGARINISEGNCPERIVTITGPTDAIFKAFAMIAYKFEEDIINSMSKSPATSKPPVTLRLVEPASQCGSLIGKGGSKIKEIRAVHRMPKVQVAGDMLPNSTERAEDQSRRTPERPIIQCDKSRSWREQCRESQHKTRDRDARQVN

SEQ ID NO: 789343 - protein, 110 aa, Homo sapiens
GNDRQCEQVYAHSLRKCSLSDPLSLTQPRVRPWQDTVSLTISSHLGDFPTGPGQQNLLLTVTMVWKDHEEFSSAVGVSDTDTDNLVTALTPFGNRTKLTLLPLSCEGQPS

SEQ ID NO: 789344 - protein, 123 aa, Homo sapiens
RGAEAEGVSRGSLPQRGRGKGNPTPGGAAGWRRPGRAAAVARWAVPWGAREGPGLEPGGKDVPRPRKRSRPPWLKGEAQGGRGDPASRGHGSRAAGHREVGAGPGRPAGVGKAAVGSTVHCPG

SEQ ID NO: 789345 - protein, 128 aa, Homo sapiens
MISGVRNLPRTRSFLWRTGSEQPHVIRPLFPVGVSSGQDILASGPSAGSGIAASAGRPKSLLSEARHPNHLCSSHFVPWSSDKTQQDFMATELEGFRATEPESDTDILIPGATGYEENTYLILSEKIY

SEQ ID NO: 789346 - protein, 156 aa, Homo sapiens
MLLEIVLLLFFKGAAPSRSLVRFWFNFYGKKTFWVVGAYVCVHRLQTSACFCAVLWTTGFGCCVFSSRSCLSGLCGCGPRGLSWLWGGWACGACWGWTWACRLGGRCSWQFLIGDFGSVGLVPDVAGVGSVIVVRVVDSAVTSWLGCGAIRGPSDS

SEQ ID NO: 789347 - protein, 38 aa, Homo sapiens
NGGKRQQGRQEATNLRERLIGGRLQHDLEQDTLIRLSN

SEQ ID NO: 789348 - protein, 167 aa, Homo sapiens
PERQRCPLPAGTRASRALRPPYPGPCTHHTWGTAVRRAWARGGEKALEEEKQPGRRRPRPQQAGEGAHGARGSASVLVETAPSARRRGCPESLRTLAGGPAPAASAAGRTLKKRRNGRGPAALPYSPRRSYRARPSISYAALSPLLAFPDVRCYSRLQPLRPPPSRL

SEQ ID NO: 789349 - protein, 109 aa, Homo sapiens
ASALRANPRRELESLILREFTDCPLPFLHRRPRLPRGNASARDYISRHASPAGPRVLTIAAGLLAGALALLWFVSAVSECQLLALLVALSLLLAFLEQGAFQASWRWRS

SEQ ID NO: 789350 - protein, 60 aa, Homo sapiens
YNTPRVLASFNHLVSDFYLIHTSHNSKRQLSIHCSVDLSNSVIIRWKLVYLDAIADQFTH

SEQ ID NO: 789351 - protein, 177 aa, Homo sapiens [sequence omitted]

SEQ ID NO: 789352 - protein, 157 aa, Homo sapiens
VTTSLRALSRVASYRKPAWQPSPCQSCPLPCVATTSCVPCGSCRIQHHLYGGPLPGPVSPLRTADRQASCLADTSPSAYVSPARDPLSHPIICLSPKHPASQERQSEPEPVQLSGRGAALLHCSAWVSLKRGIGPWSLISWKGQVMFDKVFWVCSKV

SEQ ID NO: 789353 - protein, 65 aa, Homo sapiens
LQTEEPGKPGCPLGSFTCLLYDLGQAPSPLCARLFHCKKMATIMVPTSKGEMKQSDVCRVPQRAP

SEQ ID NO: 789354 - protein, 112 aa, Homo sapiens
MSIPPPAWRPTMPTFSTQAFQICFGHLKTERIIFQESETLHVPFPLLRMLFPFSQLPYHQPGKIFISAPKISDITSPGAFPDASLDSRRSYRHFCLASTFSPLHLYAMAIYW

SEQ ID NO: 789355 - protein, 113 aa, Homo sapiens
MEEERKTAELQKNRIQDSVVFEDVAVDFTQEEWALLDLAQRNLYRDVMLENFQNLASLGYPLHTPHLISQWEQEEDLQTVKRELIQGIFMGEHREGKNPWEKLFWLGEKINLK

SEQ ID NO: 789356 - protein, 289 aa, Homo sapiens
KNEKPGKVSKGCKKPAKQNGKKATSKVPSAPQFVHSNDHANREAEIKKRVEEMREKQQAAQEQERQKRRSIKSYCEDILRRQEEFQCKEEVLQELNMFPQLDDEATMKAYYKESVEVVEYSDVILEVLDARDPLGCCCCFQMGEAILWAEGNKKLVLVLKKIDLDPKEVVKWLDYLRNELPTVAFKARTQHQVSFGAENLMRVLGNYCCLGEMRTHIHMDIVGLPNIGKSSLIKSLKHSHACSVGAIPGVTKFMQEVYLDKFIRLLDAPAIVPGPSSEVGTILHNCIHI

SEQ ID NO: 789357 - protein, 343 aa, Homo sapiens
PTLHPVAPDVRCPLPRGVLSALPTLHPVAPDVGCPLQRGVLSVLPTLHPVAPDVRCPLPRGVLSALPTLHPVAPDVGAPSSGGCPLQRGVLSALPTLHPVAPDVGCPLQRGVLSVLPTLHPVAPDVRCPLQRGVLSALPTLHPVAPDGCPLQRGVLSVLPTLHPVAPDVGCPLQRGVLSALPTLHPVVPDVGCPLQRGVLSVLPTLHPVAPDVRCPLQRGVLSALPTLHPVAPDVGCPFPRGGLSALPTLHPVAPDVGCPLTWGSFLPSPALPTLQTFPAPPHLRWRLLSSWGLARSPIPAHPQRFLSWLLVFCCIVGESHLLGGGGVAGSPWSLPVHLSLPP

SEQ ID NO: 789358 - protein, 276 aa, Homo sapiens
ASWSSLGLRGRRLRVSLLKAVVDQAGSRILSYIAGLVVDLGFGGGSRVVGGMADLGLGGGGKATRSRGGSGAGGGRLKIATMRKLFSFGRRLGQALLDSMDQEYAGRGYHIRDWELRKIHRAAIKGDAAEVEHCLTRRFRDLDARDRKDRTVLHLTCAHGRVEVVTLLLSRRCQINIYDRLNRTPLMKAVHCQEEACAIILLEHGANPNIKDIYSNTALHYAVYNKGTSLAEKLLSHHANIEALNEEGNTPLLFAINSRRQQIVEFLLKNQANLHA

SEQ ID NO: 789359 - protein, 202 aa, Homo sapiens
ASWSSLGLRGRRLRVSLLKAVVDQAGSRILSYIAGLVVDLGFGGGSRVVGGMADLGLGGGGKATRSRGGSGAGGGRLKIATMRKLFSFGRRLGQALLDSMDQEYAGRGYHIRDWELRKIHRAAIKGDAAEVEHCLTRRFRDLDARDRKDRTVLHLTCAHGRVEVVTLLLSRRCQINIYDRLNRTPLMKVYSSQLFQHEMDLI

SEQ ID NO: 789360 - protein, 35 aa, Homo sapiens
MAAPGSAFLPLTHRNRMWQSGGQMTEMLVLSELRP

SEQ ID NO: 789361 - protein, 275 aa, Homo sapiens
CLSMSELIAEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEDDNPPCPRLYGVLMEVEEPEVLQDSLDRCYSTPSMYFEQPDSFQHYRSVFYSFEEEHISFALYVDNRFFTLTVTSLHLVFQMGVIFPQ

SEQ ID NO: 789362 - protein, 104 aa, Homo sapiens
DFCLHSLANSICKDDKKYFILAEHIAAQCSITMKIRGKWMLCNPEAWCMHQNLLVALLRHGSSPLFTGDPFQDPQWMPKTTDSTERYIFCFLCFILDIHTYGKV

SEQ ID NO: 789363 - protein, 115 aa, Homo sapiens
MAAPTSRSLPYRASLKMAAPRQPAFSIWSLPPSSGLKMAAPALTKPGPAPCNPEIWISVSSRLSRRHTGGHNEESLNKGTPGSTAWPTLVAWILRGNLGFYILPRKERLPLERKY

SEQ ID NO: 789364 - protein, 142 aa, Homo sapiens
PARGSARAARPLRLPGVLPAGGAGGCVREKAKGAAGWERRESRREGGGEAGGRGAPRSSSQGRGSPARHGYSNPSTSRKRYFLRLGGFCILSSHRWGWRRPTRRPVAARELSFQYRDSELIQSAAEGAHPSYRAAECLWLEQ

SEQ ID NO: 789365 - protein, 156 aa, Homo sapiens
ARQRLGSRGAAAATSWSSACRGRGRVCEREGEGSRGVGEEGVPAGGRGRGWREGGSTELQPGPRFACTSRLLKPKHVPKAVFSASGRFLHPQFPPLGLAATNCKRNSLGGEAGGCGGWEGDSEGWEVNAGLDRLSLSFSADLSQPESCHFSTGIQN

SEQ ID NO: 789366 - protein, 68 aa, Homo sapiens
EDEVILHQGGLHSDTSGTTGVLIRRGDRHEEKAMEIQRHRCRGRPPCEDVGRETSSQGLPMATRSWER

SEQ ID NO: 789367 - protein, 106 aa, Homo sapiens
MENSLEFPQKTKNRATIQFSHPTAEYTPKRKEISISKRYLHSHVCCSIVHNSQDLEQPKCPPTDTWIKKMWYICTVIKKELDLIICNNMDETGGHYLSEINQAQKD

SEQ ID NO: 789368 - protein, 156 aa, Homo sapiens
IGSSSVTQAGVQWQDHNSLQPQLPEYKRSSHLSLLSRWDYRHTPPHLAKFCTTCRDGILLCCPGWSLTPKLKQSAHLVLLKRWDFMREPPRLVCLSISDQTGPTLWVCRQGNRDPEKGSNMLKPTQQAAGKGQERICPPDDSAQHRLPSLLIPYPI

SEQ ID NO: 789369 - protein, 98 aa, Homo sapiens
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGI

SEQ ID NO: 789370 - protein, 98 aa, Homo sapiens; identical to SEQ ID NO: 789369

SEQ ID NO: 789371 - protein, 69 aa, Homo sapiens
DLKLRVIPLASLVSGFTTWTEPHYWLLRFSSLQKVIWDFSASIIIINRIPRSDLVLNDLEVKRKSPFLQ

SEQ ID NO: 789372 - protein, 106 aa, Homo sapiens
MGPGRQRAKVLLGETSNALVERGLFSTSDTVLSQFLPIRLEPLPAQPGRWACARFGHVQVLGLCPGCKVLLTGCGLWSWKGRFKGWCKASTACAGLPRKAASMTTG

SEQ ID NO: 789373 - protein, 125 aa, Homo sapiens
QQEVITLFMIETVQISNQAAVTPLRHQKKLLPYGYIVNSIIAFTISLLLFFRARTAFALDTFACDMTNSMSLTSTPVSSTSSSSLSSCWELKLPTRILDHICLTHINVMKLKMDNTNGFDITYCT

SEQ ID NO: 789374 - protein, 84 aa, Homo sapiens
MLRSLSTLRSSSCMSGLGGECQPPAGGSESAFPAPRCPGPSPPGRPGAGGGAEPSHGPAGDGFRGARPAGLGWARDRGWGGGGR

SEQ ID NO: 789375 - protein, 139 aa, Homo sapiens
MATPRLPHKTPTAWRLLRYPRGKLHPRKYTLQPPAVPLDPARFLLYPGAELSLPRGPAHLRGLEFPSFSLPTRAADTQLGGLGFHGLPACAKGPPQGGGKAVNPSNNYAHDIMSPAIPDQGHHKRRAGCLISCLHLPQT

SEQ ID NO: 789376 - protein, 154 aa, Homo sapiens
SASRLDVRGQLEDLMGQHKDLWEFHMLEQRLAREIRALERSKEQLLSERRLVRAKLREVERRLHSPPEVEGAMAVNDGERRKLEIIRGSKVRKPPPKVRGPAEERGRTLSSPRALRRGGFPSRRWGWPLTPSRGQQGPGPCPDPSPRPQEIKGR

SEQ ID NO: 789377 - protein, 103 aa, Homo sapiens [sequence omitted]

SEQ ID NO: 789378 - protein, 117 aa, Homo sapiens
DASPGAFSLCCSQECLLSRLPLLSCCPGSFIHHKPGNRFSCAESPVPWRLFPPCSWFALPAWLEHVFQQLPEKESAWEVYFVESENIFSILLYLIGIQGKYNPKLEILLPLNFEGMS

SEQ ID NO: 789379 - protein, 149 aa, Homo sapiens
RLGPAALSGSQALGLGSGSGSAPLALRRSHSSRGHPHPRLTDVPGTQMSRGVRGQGAPSLLLQPVKPGTAAPSPRAEAVSAARSDAPRPKGREIRGEPGDLRPRGAEGCTAPAPTGLFREDASPSCPREVLGSWMRKSLLSPAPRPRAF

SEQ ID NO: 789380 - protein, 70 aa, Homo sapiens
MSSLAENEANYSKQQTEYHPAITFLCICPKELKTWVHTKTCTRDIRSLIHQCPNSDTTKASFSGQTDKPC

SEQ ID NO: 789381 - protein, 102 aa, Homo sapiens
LIYVFLVVMGFCHVGWAGLESLTSGDPPASASQSAGITGMSHHAQPKRMSVSFQTFVLVQIFLNSTLFTQIASTISSKVHPRSGKMLGPRYLLCSFPKGTFL

SEQ ID NO: 789382 - protein, 104 aa, Homo sapiens
QFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAK

SEQ ID NO: 789383 - protein, 113 aa, Homo sapiens
QPPLGQFSVPGRQSPQPLPGSREGGGKVARPGLPGSRVGGGILVSQGRTCSRPEAGRITQKHGGCWGPVLQVGCHCCPPFPYSHPHSLLHPETAGVEERLGPESHICPHLAAV

SEQ ID NO: 789384 - protein, 81 aa, Homo sapiens
RSNLFLDPVQFLSQLQTQFGSEIFSNSKTQIHGAPKSERELTMIPSHSERSMDTKMGPALSSLSTPGVARSSISEPASDTI

SEQ ID NO: 789385 - protein, 178 aa, Homo sapiens
TPVSWPVSFSAVCRLQAALRFLPVSDKDSAPLLNTTVPATGCHSRSHPHDHPLQPTCQCHLWSPLPPRIHLLIVLPHLRFIPWAKNVPPNSLFILRDPDKCHHRSGTFPCPTPDLVSPQQLAHPLVQHYTCPYTQLPPLPDSELLECAAWLLFSSSPTPHTRPGTEQPLAINKPHFKK

SEQ ID NO: 789386 - protein, 166 aa, Homo sapiens
KHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIHIRERSMENVLLPCSQHTPEISSENRPYQGAVNYKLKLVHPSTHPGEVP

SEQ ID NO: 789387 - protein, 166 aa, Homo sapiens; identical to SEQ ID NO: 789386

SEQ ID NO: 789388 - protein, 157 aa, Homo sapiens
MSLHLLLPGCKGLTGFPATQAQHCQHGLFKPNSNGITALLKIPTRTPHFQGLTLCSPCDLTNSTPLSSLYPRCSHHKGLLASLGISQVYGPPTLKSFAVAVLSIWNILHPDSLMANSLISIKSSNSWPGAVAHACNPSTLGGRGGRITRSGDRDHPG

SEQ ID NO: 789389 - protein, 123 aa, Homo sapiens
PRPPAGAAEGAAEGARRRPRARLHARLLGPSALAPSKQRNGCGFVPVTRVLEILTLLNVPKGEGVQGWRLSQKAGTLRASLPRRPSFLGLAPELSWVSVSSRRERLRGGVDLGLSRLPCGPGE

SEQ ID NO: 789390 - protein, 138 aa, Homo sapiens
MDPILSEVLLVCLHLSCHLEFQRGGPGQHVGCCKDPHRGGMPEAILLAMVVPGSLFVSRLPEAVTYSGLVSQCFAELKEAPGRHESHERVGLLSILAGADVTCCLPAKFPHTCWSDSSNISLQGVVSLSLEDIQSPVI

SEQ ID NO: 789391 - protein, 113 aa, Homo sapiens
RQAQLTQLGREPRRPLNLLTPWREGLRFHGCFVCLFCFEMESHSVAQAGVQWHSLGSLQRPSPRIKGFSCLSFSSSWDYRHAPPCMPNFCILSRDGFRHVGQAGLELLTSSDP

SEQ ID NO: 789392 - protein, 83 aa, Homo sapiens
FHPTPQSPFLNPTLDLIRFELGPIQLRWPSRPGEGIFFFPNPLWWILKDHIRITVQYREGSGKFSLSYTRVGLGMVAYSCGLS

SEQ ID NO: 789393 - protein, 72 aa, Homo sapiens
MGDTVVPSVPQVMLIWSGGVVGETASEGSTAGGPSTWLFQGPGGQGTWGSRTKEETLVLVIGVEIKITKEPL

SEQ ID NO: 789394 - protein, 107 aa, Homo sapiens
GARGGQLLSTRILRKLTRIQFPQAKLKLCLEKQFLCPLVLLNVTPVWRICRTIWLQSLQLFTEQTHRVINYSLPIIVFPFFLPKRSFHFSAPEPEVWVTFLWVHTLP

SEQ ID NO: 789395 - protein, 91 aa, Homo sapiens
SAAVLGPTLRSVESAAGRGGTRKLCKAEGAASDQEPYPSGGSYGRVTVAARQLGPGSSGRAGVVTSAKQGFWAVIESCSRACRETPAALPA

SEQ ID NO: 789396 - protein, 123 aa, Homo sapiens
MKGKKLLCWRVTPGRACLDRGHPGAGAFLSRGQETNLEVKMISYLNTRCRESRFGASSAHSFCIAENCPSDSTAAFSFGGPGPYWVSAACCLSVYPAIYHVSLSHLLCFHPGLHEYQYSMLCT

SEQ ID NO: 789397 - protein, 139 aa, Homo sapiens
MASLFRSYLPAIWLLLSQLLRESLAAELRGCGPRFGKHLLSYCPMPEKTFTTTPGGWLLESGRPKEMVSTSNNKDGQALGTTSEFIPNLSPELKKPLSEGQPSLKKIILSRKKRSGRHRFDPFCCEVICDDGTSVKLCT

SEQ ID NO: 789398 - protein, 102 aa, Homo sapiens
MASLFRSYLPAIWLLLSQLLRESLAAELRGCGPRFGKHLLSYCPMPEKTFTTTPGGWLLESGRPKGFFTRKSSWGSGVGGRKLAGKNIRNSLHLWEGFVAFP

SEQ ID NO: 789399 - protein, 120 aa, Homo sapiens
GGPADSAPPPSLNADYIQRPYCMRRFNESAAERHTNFCKDQSSRRVFNPAQTAAKLASRAQGRAQMGPKKEPTVTSAVGALLQNRVLVATNEVPTKSGLAMDPASGAKLRQGFSKSSKKD

SEQ ID NO: 789400 - protein, 216 aa, Homo sapiens
DYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKVPVKQSIRDTPAKNAQKSNQNGKDSNIINTKIKRTRILQETGKKLLKHQKDLVL

SEQ ID NO: 789401 - protein, 68 aa, Homo sapiens
LCGVLQQEHSMTITRFNGPCLHIKTIFCRRSLSFIEAILTGITRILARNIAIIKHYRVWRFKVLGIQM

SEQ ID NO: 789402 - protein, 112 aa, Homo sapiens
MGGDNPEVGKKARNSSKFELRKSPVFSDEDSDLDFDISKLEQQSKVQNTGHGKPREKSIIDEKFFQLSEMEAYLENREKEEERKDDNDDESVKSSRNVNNKDFFDPVESDED

SEQ ID NO: 789403 - protein, 186 aa, Homo sapiens
NAADSSDDNIKTPALPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAFHPQRMIISR

SEQ ID NO: 789404 - protein, 211 aa, Homo sapiens
NLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 789405 - protein, 234 aa, Homo sapiens
NAADSSDDNIKTPALPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGASAGAASTLSG

SEQ ID NO: 789406 - protein, 96 aa, Homo sapiens
GTPCWLLTAPLCKPTQEDPDGTRNEKHIGQRTRYNAKNNGGDVCAVARHAQRLQEGSWSQPGDTWGLSEFAACTHASKRKSPWLASLCYMKRSPRN

SEQ ID NO: 789407 - protein, 103 aa, Homo sapiens
EHRDVLVLLPSREQLRLAVGVKATGRELFQQVCNVASIRDAQFFGLCVVRNNEYIFMDLEQKLSKYFSKDWKKERNEGNEKPRAPFVAFLRVQHYVENGRVIR

SEQ ID NO: 789408 - protein, 142 aa, Homo sapiens
ERPYECSECGKFFRDSYKLIIHQRVHTGEKPYECSNCGKFLRYRSTFIKHHKVCTGEKPHECSKCRELFRTKSSLIIHQQSHTGESPFKLRECGKDFNKCNTGQRQKTHTGERSYECGESSKVFKYNSSLIKHQIIHTGKRP

SEQ ID NO: 789409 - protein, 115 aa, Homo sapiens
KKNRSHRKKGAPETTYGAKPFKFQLLPVRGHSTAPGKSPTRGQLTRELMSNRNTTPLGMFSANQGHRRLQGPAAPLSPTLASFSSCPYFLLPTPLLFSLLLPPVPLFPSSPLSVL

SEQ ID NO: 789410 - protein, 211 aa, Homo sapiens
MAVGKNKRLTKGGKKGAKKKVVDPFSKKDWYDVKAPAMFNIRNIGKTLITRTQGTKIASDGLKGRVFEVSLADLQNDEVAFRKFKLITEDVQGKNCLTNFHGMDLTRDKMCSMVKKWQTMIEAHVDVKTTDGYLLHLFCVGFTKKRNNQIQKTSYAQHQQVRQIQKKMMEIMTREVHDNDLKEVVNKLIPDSIGKDIEKACQSIYPLHDVF

SEQ ID NO: 789411 - protein, 86 aa, Homo sapiens
EIAAAYIHMMPNAVPPGDREVDNDEEKESPFDRMSQIYQTSPDGDPVAESVLRAGLRGGDFFRQNNTFHPKWIPLNCIKKPPHGSA

SEQ ID NO: 789412 - protein, 125 aa, Homo sapiens
LKGKVKLETAQGKPAFHSMQSHRLFTKTDVYSDCFFWKDLSETQMNATIFLSATCDLEASSLLLLSPSFWKKLIYFLHILIDVSYLSTMYKTKLFPYQLGHMSSGLPEVVSWMYVLNLGKINFLN

SEQ ID NO: 789413 - protein, 113 aa, Homo sapiens
GLILILQSQACSIFRLLSLALTFLPLCYKDPLLWLKWVHPPQPECEDPLLHGTPLPRTRMGPITAAQRIGRPSPGFLGRHQDVRKAQRKKKWLGMVAHACDPSSLGDQGRRTT

SEQ ID NO: 789414 - protein, 113 aa, Homo sapiens
MTLASICPKRDWAPANRKDIGSHSSWVSAIKDDSLAKSLKDGVVLADSQINYFILFFNSSEFSAERSRCYFQGWCFLEEEEANDGGSRPLAWRQSNGMKEHHLLRTTVNLSPR

SEQ ID NO: 789415 - protein, 367 aa, Homo sapiens
SYIQLLAEFLSRDQVFQQNGYGLTQQNLLNNYDMLGIMAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 789416 - protein, 37 aa, Homo sapiens
SKSEFLMRTMGSKHSSYVLKRNTSHSKQGRDKMKNLE

SEQ ID NO: 789417 - protein, 89 aa, Homo sapiens
SLSLFVSLSLSLSVCVSVPLSLSVSLSLCISLSLCVSLSLYLSISLCLSTSLAHSPLTSHPEVVLPSQRSSASLAMSAPSQLLGRAMIC

SEQ ID NO: 789418 - protein, 95 aa, Homo sapiens
RHGGRPGDPKQRQSLGSTHSTYLPLSGPRFLQNMRALCKEEKKNGRNSNLNPTLWLQLRRPTQASTVRAPSGFSQALPRHTGRLQCYHCGKGQGN

SEQ ID NO: 789419 - protein, 278 aa, Homo sapiens
LGSPAPAPAPPVARSSGRSLPARCPGVGGPRARRQPASRLRPLPVPQEPVRGVRSVPESADPGEQPSAPGTARRDPRRRAAMNATFLNHSGLEEVDGVGGGAGAALGNRTHGLGTWLGCCPGGAPLAASDGVPAGLAPDERSLWVSRVAQIAVLCVLSLTVVFGVFFLGCNLLIKSESMINFLVQERRPSKDVGSSHPGAVLSAIWVRPRQRCCKKDPGDPDPRPALCALPPPPGGQLRAWGARAGTRRDCRRGRGKGLGRPALSCVRCSVAGWENVG

SEQ ID NO: 789420 - protein, 583 aa, Homo sapiens
LGSWNPATMAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDL

SEQ ID NO: 789421 - protein, 96 aa, Homo sapiens
IVAAGIPGCTVGTAVGCWGWQRAWVPGTRSGHLWTRAEDEVIKLQIDPISLNPRMPEKLCGDDMLPTNSIPSETCPGVAAHTCNPSTSGGRGGRIT

SEQ ID NO: 789422 - protein, 144 aa, Homo sapiens
VKSKSSHLLVRKCWSWSPSESPGQARGPSALFCSTGALSLRTLSGLECPQHTQGETCPVQTHRRHLCPAQGRAGVSGTCRCRHIIWRVGRTNVAASWRPSVALHQEGAVMAGGAQQCRRGVTGSGVARWRPPVKFAIKQFPEFG

SEQ ID NO: 789423 - protein, 87 aa, Homo sapiens
MAMSLLQDWCRSLDVDAHRALLVTGIPEGLEQADVEAVLQPTLLPLGTFRLRHMKALMNEKAQAALVEFVEDVNHAAIPREIPGKDG

SEQ ID NO: 789424 - protein, 130 aa, Homo sapiens
NLSSDNQKLIVFSSPIVIKRLLQKFRPKAFASYFCEIQKDCKVLVMIRKPKAGKSQGRECIWQKSSPLDGSAGQTWERESRKLHGSSHKSAALLPRREMRLTAGLRHCLPSPAALIQDAGLGKATHILTA

SEQ ID NO: 789425 - protein, 125 aa, Homo sapiens [sequence omitted]

SEQ ID NO: 789426 - protein, 88 aa, Homo sapiens
MQCSSHLLQEGFPAPPVIHIRKPSVGLLENLVSACIIAASTVFLKLCFAESSMFQGDFSVATASCGISSVLSFIMRFPLKKDFQELER

SEQ ID NO: 789427 - protein, 125 aa, Homo sapiens
VSQAGVQWRNLGSLQPLLRGFKRFSCLSLSSSWDYRHTPPPPANFVFLVETGFHYAGLKLLTSGDPLASASQSAGITDVSHRAWPHFQHLCCISSRLLHHSITPFVLPLGVQEEACPLSQHFLFG

SEQ ID NO: 789428 - protein, 90 aa, Homo sapiens
THPPLFLAVKMIIIITILSLTNEAQSSLLEDKRPRRDGPRCLGQQPAPTARYEREAILDILVLLNSDDCSHRSDPSASLLPVAGGYVVLH

SEQ ID NO: 789429 - protein, 112 aa, Homo sapiens
SAEAPRRRPKLPRFLGTAGVLSRKGSAGGPQPAPEARAGFLFGYAERQSAPANNSSYDNNPPSFQTSETWAAASVLLFRHLPGAPESAEPPSPRSESSPSLSPTSLPGAGGQ

SEQ ID NO: 789430 - protein, 70 aa, Homo sapiens
VVQADGLRGVIPVDTGELSCEGPGLRGAMSDLQMLQSLGRVTRGIGESPLKGALWPFSGHGLQFLEPGSP

SEQ ID NO: 789431 - protein, 79 aa, Homo sapiens
TLARHAPSCTCENPETLVGTDTEQLDIDRNTPAEEDTSGWMSRGTYRRKSTLTAPADWQAINWQNDTKFGQGGRRRAWP

SEQ ID NO: 789432 - protein, 201 aa, Homo sapiens
MITETAAEPTVPAVPAAEEATEARGREEPAWPWKDAPIRTLVQRIHQLQAERAQGFRRLEEWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 789433 - protein, 179 aa, Homo sapiens
MITETAAEPTVPAVPAAEEATEARGREEPAWPWKDAPIRTLVQRIHQLQAERAQGFRRLEEGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 789434 - protein, 179 aa, Homo sapiens; identical to SEQ ID NO: 789433

SEQ ID NO: 789435 - protein, 201 aa, Homo sapiens; identical to SEQ ID NO: 789432

SEQ ID NO: 789436 - protein, 213 aa, Homo sapiens
MGRGFRGTGSSPSRKRPHSTSPLPDDSLFVASLSSPRAGVGLSRVPLRESGSVLPTYQSSPLVSGDTSWGPFRWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 789437 - protein, 213 aa, Homo sapiens; identical to SEQ ID NO: 789436

SEQ ID NO: 789438 - protein, 213 aa, Homo sapiens; identical to SEQ ID NO: 789436

SEQ ID NO: 789439 - protein, 195 aa, Homo sapiens
MGRGFRGTGSSPSRLSSPRAGVGLSRVPLRESGSVLPTYQSSPLVSGDTSWGPFRWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 789440 - protein, 213 aa, Homo sapiens; identical to SEQ ID NO: 789436

SEQ ID NO: 789441 - protein, 195 aa, Homo sapiens
MGRGFRGTGSSPSRKRPHSTSPLPDDSLFVASLSSPRAGVGLSRVPLRESGSVLPTYQSSPLVSGDTSWGPFRWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMNSHPLL

SEQ ID NO: 789442 - protein, 47 aa, Homo sapiens
MRRGRWETGRMAPSPALTASWLGLRPTALLTFLQFQTPPTIKSSSSV

SEQ ID NO: 789443 - protein, 49 aa, Homo sapiens
MQISIYRHIHIHIEEEEEEEEEEEEEEEEKKKKEKKKKKEAAAEEEEEE

SEQ ID NO: 789444 - protein, 117 aa, Homo sapiens
GRSSVHHAPPLRPGPLRGQRSQESSLYLCGTDRNPRPARRTWTERPCSEPGAGRRALVWRLGLPTVQSPEARSSRRDDDGWAGPGVGDSQTPARRDGQLRHLGRGQYFGASVMSPVT

SEQ ID NO: 789445 - protein, 71 aa, Homo sapiens
QGSANYDPEAKPSPSAFVYKVLMEQSCEPAVCGLRLPLDTAAELIPAQTSGPAEGGAFPPSSPLSTSRRSR

SEQ ID NO: 789446 - protein, 71 aa, Homo sapiens; identical to SEQ ID NO: 789445

SEQ ID NO: 789447 - protein, 71 aa, Homo sapiens; identical to SEQ ID NO: 789445

SEQ ID NO: 789448 - protein, 96 aa, Homo sapiens
VVGERPFHPVSREAACSRPHLGRSPGSVFTVGEAPGPLLDAAGMAEIFSPEEGGSVLHCGVVVSASSPESPSRICGSWWAGIRSNRMVTGTEQRKE

SEQ ID NO: 789449 - protein, 136 aa, Homo sapiens
LPRPGGNALPAVTPAGGGGRDPCAEPPPGPAPAADGGGGWGARVWPPAHPLASTSRAVGGCALPRGQALEGPWRCRRPQPMAQRYDELPHYPGIADGPAALAGFPEAVPAAPGPYGPHRPPQPLPPGLDSDGLKRD

SEQ ID NO: 789450 - protein, 419 aa, Homo sapiens
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWVLTEGTEVAGQSCFPACQTPESSRFSICAKDVCVLKTWPLASNVSAASICQLLLVGLRTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKEGHTSTIQTLLSLGADINSKDEKNRSALHLACAGQHLACAKFLLQSGLKDSEDITGTLAQQLPRRADVLRGSGHSAMT

SEQ ID NO: 789451 - protein, 361 aa, Homo sapiens [sequence omitted]

SEQ ID NO: 789452 - protein, 361 aa, Homo sapiens [sequence omitted]

SEQ ID NO: 789453 - protein, 304 aa, Homo sapiens
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKPCIWPVQVSTWPVPSFSCSRD

SEQ ID NO: 789454 - protein, 361 aa, Homo sapiens [sequence omitted]

SEQ ID NO: 789455 - protein, 358 aa, Homo sapiens
MDIEATNRDYKRPLHEAASMGHRDCVRYLLGRGAAVDCLKKADWVLTEGTEVAGQSCFPACQTPESSRFSICAKDVCVLKTWPLASNVSAASICQLLLVGLRTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQDEAIRFLVSELGVDVDVRATSTHLTALHYAAKEGHTSTIQTLLSLGADINSKDEKNRSALHLACAGQHLACAKFLLQSGLKDSEDITGTLAQQLPRRADVLRGSGHSAMT

SEQ ID NO: 789456 - protein, 266 aa, Homo sapiens
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQGRTYKYNSDSLILGS

SEQ ID NO: 789457 - protein, 257 aa, Homo sapiens
MAQPGDPRRLCRLVQEGRLRALKEELQAAGGCPGPAGDTLLHCAARHGHRDVLAYLAEAWGMDIEATNRDYKRPLHEAASMGHRDCVRYLLGRGAAVDCLKKADWTPLMMACTRKNLGVIQELVEHGANPLLKNKDGWNSFHIASREGDPLILQYLLTVCPGAWKTESKIRRTPLHTAAMHGHLEAVKVLLKRCQYEPDYRDNCGVTALMDAIQCGHIDVARLLLDEHGACLSAEDSLGAQALHRAAVTGQASWLTW

SEQ ID NO: 789458 - protein, 109 aa, Homo sapiens
VPPPPPKSVDHKSWPTLTWFVKYLPLCTFPFSLRLLADSLTTEAAWLSSGSTNLKAHQPANLECILHPWVTELRSPRLCNPRTLQPLRPNTQALPCRRAEMLRRPSGVS

SEQ ID NO: 789459 - protein, 72 aa, Homo sapiens
SAAGPSPLRATSRISESLNYEHWCYCPDFYHRLHLWPVFIGSIIDCHLDRPFLANTGLSRSLENPVGKSESW

SEQ ID NO: 789460 - protein, 157 aa, Homo sapiens
SHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMSEWVQGTELEF

SEQ ID NO: 789461 - protein, 118 aa, Homo sapiens
MDPLRAQQLAAELEVEMMADMYNRMTSACHRKCVPPHYKEAELSKGESVCLDRCVSKYLDIHERMGKKLTELSMQDEELMKRVQQQLWACMRSLSVYTLGCTPPLPTLINVLPVGCHL

SEQ ID NO: 789462 - protein, 145 aa, Homo sapiens
MDPLRAQQLAAELEVEMMADMYNRMTSACHRKCVPPHYKEAELSKGESVCLDRCVSKYLDIHERMGKKLTELSMQDEELMKRVQQALGLHEVPVSIHPGVYPTPSHFNKRAPCWVSSVKNSSKLIHSAQIRAYLGNSPYEGAYYN

SEQ ID NO: 789463 - protein, 118 aa, Homo sapiens
QGRDTSTENHLVPSKPRNAQLYVPHSAIAKLVANEEVLLLCFSQESSRTCGRDDGCFHAPIDQLAEEVRMTKFIPYKQHHQLSLGYDFYIHKHHDHKNVFIDFYVSCFHVYKDSSCLF

SEQ ID NO: 789464 - protein, 320 aa, Homo sapiens
RDPGCGAQHCAVMVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGRWVWVCLGDEQVGGHTRGEWS

SEQ ID NO: 789465 - protein, 340 aa, Homo sapiens
RDPGCGAQHCAVMVGQMYCYPGSHLARALTRALALALVLALLVGPFLSGLAGAIPAPGGRWARDGQVPPASRSRSVLLDVSAGQLLMVDGRHPDAVAWANLTNAIRETGWAFLELGTSGQYNDSLQAYAAGVVEAAVSEELIYMHWMNTVVNYCGPFEYEVGYCERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGDYPLVPGNKLVFSSYPGTIFSCDDFYILGSGLVLRHHWKKT

SEQ ID NO: 789466 - protein, 198 aa, Homo sapiens
KLSVGDTGPAMDSRARDHMTGPGWKTFKNKYAGCNQQSVPLRERLKSFLEANLEWMQEEMESNPDSPYWHQVRLTLLQLKGLEDSYEGRVSFPAGKFTIKPLGFLLLQLSGDLEDLELALNKTKIKPSLGSGSCSALIKLLPGQSDLLVAHNTWNNYQHMLRVIKKYWLQFREGPWGRWVWVCLGDEQVGGHTRGEWS

SEQ ID NO: 789467 - protein, 73 aa, Homo sapiens
QGPDPCQPGGSLWAAALAAHLGQLGQHSLWERPLTPMPSLGKAEALEGWNIRHVGDIIENKNLLPMQKTFPQK

SEQ ID NO: 789468 - protein, 411 aa, Homo sapiens
SGCPRTSPRRPRSAARPRLRSAPAGARPRAPPPPTRRPDREEPMAGPAIHTAPMLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRNRALCGARDGQRRPGILHQRLAAPRDWGLSPGGCTKPGE

SEQ ID NO: 789469 - protein, 116 aa, Homo sapiens
RFGQKVGPVGPFRGPWLRVPSLPPDLPPAATGRSLLHCKVIKQTAQLAVLSSLAAILFSGHLAFISVILGLSLLEVPLKEADTLASVKDLHSQANASPAFTRTSLTKKRPHNRGFW

SEQ ID NO: 789470 - protein, 148 aa, Homo sapiens
MPVLKQLGPAQPKKRPDRGALSISAPLGDFRHTLHVGRGGDAFGDTSFLSRHGGGPPPEPRAPPAGAPRSPPPPAVPQSAAPSPADPLLSFHLDLGPSMLDAVLGVMDAARPEAAAAKPDAEPRPGTQPPQARCRPNADLELNDVIGL

SEQ ID NO: 789471 - protein, 142 aa, Homo sapiens
RPLDNIERGVLHGYPEPCGTGRVGLELERETRREAGAEGRRASGRERRAEETRATSVRTGTPPRGASAFPPLLSSPLTPRGKLLGDKKAWEGPVPKPSLPGDWAVIPLLPGLLPWPPRGADTLAPGAGENPPGGRRKARAGD

SEQ ID NO: 789472 - protein, 119 aa, Homo sapiens
MPVLKQLGPAQPKKRPDRGALSISAPLGDFRHTLHVGRGGDAFGDTSFLSRHGGGPPPEPRAPPAGAPRSPPPPAVPQSAAPSPADPLLSFHLDLGPSMLDAVLGVMDADLELNDVIGL

SEQ ID NO: 789473 - protein, 142 aa, Homo sapiens; identical to SEQ ID NO: 789471

SEQ ID NO: 789474 - protein, 74 aa, Homo sapiens
RPLDNIERGVLHGYPEPCGTGRVGLELERETRREAGAEGRRASGRERRAEETRATSVRSRDSAQRGLSFSTTAF

SEQ ID NO: 789475 - protein, 111 aa, Homo sapiens
MPVLKQLGPAQPKKRPDRGALSISAPLGDFRHTLHVGRGGDAFGDTSFLSRHGGGPPPEPRAPPAGAPRSPPPPAVPQSAAPSPADPLLSFHLDLGPSMLADLELNDVIGL

SEQ ID NO: 789476 - protein, 116 aa, Homo sapiens
EGPSPLLGSWIRVYFKAHSYLLAWQSIAKPGENQPFMYISGECNVPPLWRAIWLLSIEIKNMRLFLERELLGEFILQIPSRVCNDSRTRMFFKSGSQPVCYKGHELFSKMIMVLCF

SEQ ID NO: 789477 - protein, 33 aa, Homo sapiens
MFRFAAGREPRRARSWDQLHSPGFGEREAVSLP

SEQ ID NO: 789478 - protein, 75 aa, Homo sapiens
RPPRREPAGAGRGRVPMNSGVPATLAVRRVKFFGQHGGEVRSSGLCPDSRLWMQSGSWFCVVGVPECSLGSGSGH

SEQ ID NO: 789479 - protein, 381 aa, Homo sapiens
RPPRREPAGAGRGRVPMNSGVPATLAVRRVKFFGQHGGEVNSSAFSPDGQMLLTGSEDGCVYGWETRSGQLLWRLGGHTGPVKFCRFSPDGHLFASASCDCTVRLWDVARAKCLRVLKGELSWEPSSQASVPFQMVLCPVSRHLSTFPDPGLVPAGHQRSVETVSFSPDSRQLASGGWDKRVMLWDVQDVEGLGPPVWDSRTSSREDVTSLALPAQTLHWFPWPMPTAGNQGCPHLATAASPGFLAHSSPQAFCTRSPFPGLSRPGSRLPSAAFCSSGLSLVRQMLRLLVGHRDSIQSSDFSPTVNCLATGSWDSTVHIWDLRMVTPAVSHQALEGHSANISCLCYSASGLLASGSWDKTIHIWKPTTSSLLIQLKGHVTW

SEQ ID NO: 789480 - protein, 102 aa, Homo sapiens
MRIDSCDYEGQEVPQHAISKVENQGGQCCKSGQVQRPENQRSQWCHCQFKAESLRDWRPTGVKTQEPAALISNDSRCMSQRDSEFAFPLPFLSIQALNGLDH

SEQ ID NO: 789481 - protein, 70 aa, Homo sapiens
KPLASGFWDVGWAEVRPGFSLLGAPVSYLRSPFFSGAQPACSGSLASRKTRLPLLAHSKPLPISNLLPSH

SEQ ID NO: 789482 - protein, 615 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 789483 - protein, 615 aa, Homo sapiens; identical to SEQ ID NO: 789482

SEQ ID NO: 789484 - protein, 615 aa, Homo sapiens; identical to SEQ ID NO: 789482

SEQ ID NO: 789485 - protein, 615 aa, Homo sapiens; identical to SEQ ID NO: 789482

SEQ ID NO: 789486 - protein, 355 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTRRAAGLERGAPALGSGGGRGVPARAVPPFPQLHPAADTAAALGLAPPPLPPRLAAFAPLSRPGGPGAARAGGGGGGGAPAAGAGGAGELHRARAAPAPVTALPGPAPARPRRARAPAPPSVLPAPPRCLHAPRPCPLALPLSPGCVGTCQTPLPGPEPELPELTRG

SEQ ID NO: 789487 - protein, 381 aa, Homo sapiens
MPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 789488 - protein, 330 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPKGPSEHSREGVSPKTREIGPCKRQGRRPRAAEAIWGPGRSPSTAAERAREQTSGKKGPPDIWDRGRGRGETRRAGEKHCDRRVLSIFFFAPEDK

SEQ ID NO: 789489 - protein, 73 aa, Homo sapiens
RGYSPSILENKVAVKPLMAARNSVTEFMTPRGKMFGGSLGGGSQDFCQKRSIYSEPAWDQETETTEKATGPAP

SEQ ID NO: 789490 - protein, 73 aa, Homo sapiens
MATKFLAQHLGKWLPSGNQESSIWDVHVEQVVTWSTGACARAIELGIVGTEMAWEAPEDIHSRVPGTREGYLP

SEQ ID NO: 789491 - protein, 104 aa, Homo sapiens
RQVTLLPRHSFFTCKMKGLGKTVSKVPRARCSGSRLSSQYFGRLMQKDHWSSLKTSLGNTGRTLSLQKIKNISWTWWQDLWFQLLRRLSGEDILNLGGRGCSEL

SEQ ID NO: 789492 - protein, 133 aa, Homo sapiens
PPDLISHYCGKPVNHLQPFAGYKRPSTNPSLSRCASTSNALPNADHWVLAQAHVRKNTWILWGRGRWRITFGECQRSAGLCAKCLIFGVWVRALIYHCMYGLALEDCSHSLDVDFHHTPQVRETCGHTCVCSM

SEQ ID NO: 789493 - protein, 154 aa, Homo sapiens
MRKGVQGTTEEQREGASNHIRLLRLKSESGRAGRSAGEVRNGRQEKSILDRVASRPLHTAQPADSLPLALWMPPILLQLSTPPAVPTSPVPLRLLALLCQYRPHSPLLSPPPRLIPPHSLLIRGHALPSLSIPHLCSSPSPLPLLPYPPHPSLP

SEQ ID NO: 789494 - protein, 93 aa, Homo sapiens
EKELMFDANFTFKEGEIVEVDEETAAILKNSRFAQDFLIRPIGEKLPTSGGCSALELKDIITDPFKLAEESDSMKSRCVPDAAGGCCGTKKSC

SEQ ID NO: 789495 - protein, 407 aa, Homo sapiens
MGCWPDGTFGLLNQSSVRISRAKTSAALGQAGSVQAGAETRSRALAPTGLAPTSKTAGPFAVRRPRADSVQDLLLHSSFSLSLPVPPDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 789496 - protein, 157 aa, Homo sapiens
PLQIQWYPCLALRESRSSLSHNVIMSYFYLQLVPRCFWGDSREATPNPLSLRCAPRNSLLLAWSSLKEWRGGWPRTEGASPPSSPPSALAPEGNPATTSSAAPPASSPGRGSPDESPRSRFQALGAWTLLRQQPGTGRILHSHPCVLALQANLILFC

SEQ ID NO: 789497 - protein, 144 aa, Homo sapiens
RTQNNPSFESRGNNLADEIAKQAASSQEAPICHLTPCPSYPAVIPIFSLADQEKLKKIGAKESPEGKWVLPDGREILSQLHQGTHWGPQAMCDAALRVYGCVGIYTLTRQVADDCIVCRKTNKQTLKKQSLGGRNPGLRLFQSV

SEQ ID NO: 789498 - protein, 136 aa, Homo sapiens
ISPPPTPFPFVFTKRAEQFKESSSPATIFCTAVARQGKPGLAGELSSYQAPPRACCVSLVHLCCISGAHVQSKGGIRSSPESQKEGLIIKNMSACDKSRVYHMILCVSSWVMTCIGFMLIKVMSSMLHVETFENFN

SEQ ID NO: 789499 - protein, 98 aa, Homo sapiens
MPAAPWSFRLRLSAELALSVTVISRYISKGDLQTLSADKVEWELLSLPPRVCIGSSGPVSTLVYKSAARTLESVAALGFTWFSHMRCDGHWIKCYCTH

SEQ ID NO: 789500 - protein, 121 aa, Homo sapiens
MYQPGAAGNTSSPGRVHRPTVGRAGVRLCAGGGRRARDGEGGCTNPLGGDQNAPPLPAWASAAKCMGSADGGCGGWRGANSFCSGQDRKALSPDTQKQEGHIKPIINILPGKNTKSIFFSE

SEQ ID NO: 789501 - protein, 105 aa, Homo sapiens
VEVLTQHRAPAQPLISPEQFKHLKDQQKIIIQQLNTPGNDELPPNLSRAHDSISNSALLRHCLETNSTLIVNQKMFKFTYSLKAPNSTLSCSTFLDQTNVFLKCM

SEQ ID NO: 789502 - protein, 161 aa, Homo sapiens
SGRAGAPEAQGPAAPGTTAPEGGDRCRGYYDVMGQWDPPFNCSSGAYSFCCGTCGYRFCCHDGPRRLDQSRCSNYDTPAWVQTGRPPARARDTAAPRDPGRERSHTAVYAVCGVAALLVLAGIGARLGLERAHSPRARRTVTRALTELLKQPGPQEPLPPT

SEQ ID NO: 789503 - protein, 111 aa, Homo sapiens
FTAELPPLSSVRGVSLKSLASLTKACPPKVPWSWSSLSMTLRQYLRSKMLSSEPEFLLSGKLRPVCALLLGQGPPSFFASKCGLPKTGLGPAWASLKAEKDGPCGGSPMSG

SEQ ID NO: 789504 - protein, 111 aa, Homo sapiens
RPGGRPALRQYLGKTHLQLSRVLLLPEPIGLGPDGPEWGRTDHRRNPQQKSPLPSSQGGGKGGAPWSEIRAETSAELGLNLKNDFLVLIPRPQQFLLRERQNQGTFLTARG

SEQ ID NO: 789505 - protein, 432 aa, Homo sapiens
MASSVDEEALHQLYLWVDNIPLSRPKRNLSRDFSDGVLVAEVIKFYFPKMVEMHNYVPANSLQQKLSNWGHLNRKVLKRLNFSVPDDVMRKIAQCAPGVVELVLIPLRQRLEERQRRRKQGAGSLQELAPQDGSGYMDVGVSQKARGEGVPDPQGGGQLSWDRPPAPRPPAYNRALQGDPSFVLQIAEKEQELLASQETVQVLQMKVRRLEHLLQLKNVRIEDLSRRLQQAERKQLVSGGPGRAGTPGYPPEPRRRAGPTHRWIDHWEGGARCSHEPAGARVPSFLGMGERGRRWDRNSRSAGPGLSRLLPLRRSGSGEWTAFQSPEATCRDLACPPKQCPTPWARPCISRRWALGGGPLALSTPPESGPRPAPRTAASPSRLVPHALSHGGICPGPLRGSPAPPGSLPGTHLGDGDRSSWRGRGEAWDRQE

SEQ ID NO: 789506 - protein, 162 aa, Homo sapiens
MASSVDEEALHQLYLWVDNIPLSRPKRNLSRDFSDGVLVAEVIKFYFPKMVEMHNYVPANSLQQKLSNWGHLNRKVLKRLNFSVPDDVMRKIAQCAPGVVELVLIPLRQRLEERQRRRKQGAGSLQELAPQDGSGYMDVGKVAFSISPSRLELSFCPSSCHL

SEQ ID NO: 789507 - protein, 111 aa, Homo sapiens
NYSLLNRTLHFSTSLSTGEKEKPAKNQQLLATLIRRLMKAMKQRWKNTSHRPLPDASILILDFPAFRTQLQRYANALHQVAATCLRPTLKISHGITAYLNKGHERRHRWVN

SEQ ID NO: 789508 - protein, 90 aa, Homo sapiens
NYSLLNRTLHFSTSLSTGEKEKPAKNQQLLATLIRRLMKAMKQRWKNTSHRPLPDASILILDFPAFRTIRLQSSNPPYQVDQAQLLLIPE

SEQ ID NO: 789509 - protein, 103 aa, Homo sapiens
MFCHLRPMRRLCLEKIFPHWFPFSRALSGAEAVNALRPFYFAVHPDFFGQHPVEREINENSVNKVKCLPRKPPETRLQVFETNSAYILCKRNRPEFLRWPGTF

SEQ ID NO: 789510 - protein, 74 aa, Homo sapiens
ADPHLPLRKCLVQMTTGCWKAETGFRKSLDWAVSVVQGDGEKGPCCSHRTGSVNLQTLVAEWIEGRKSMIEGPG

SEQ ID NO: 789511 - protein, 149 aa, Homo sapiens
CFQFKAFPFLTLSCLFHLLLLLQLSPLFALSLRAFDIFKVERSIGSYVHIYSRLLETFVGLSCHALLGWQLWVWPSFMQLCIQLRDEMSPLLLIGTLHSLGSFLGAPFMWLGAGGRDSFPSPVAQLPNFLTSLYTLDMTIFRRQVRVKR

SEQ ID NO: 789512 - protein, 104 aa, Homo sapiens
MNQIIPALMGCQRKTAARDPLETEQREEDTFPEAQMFQKPAPHSQSHPKNALEFGVLKKREEGLSKGLGTKLDPTSASAHASDGAHRWRAACPSFPWCPQTHLG

SEQ ID NO: 789513 - protein, 152 aa, Homo sapiens
EGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 789514 - protein, 95 aa, Homo sapiens
ARFKFYFKFRGYTHRFVTRVSYDAEVWGAIDAITQVASLVYNSFHPPSPSFSLPALSSVSVAAIFISISTPCLASTCLSKWKRKHGVHYGYKVRA

SEQ ID NO: 789515 - protein, 155 aa, Homo sapiens
GHGQVFTQNSSYSHHENTHTGVKFCERNQCGKVLSLKHSLSQNVKFPIGEKANTCTEFGKIFTQRSHFFAPQKIHTVEKPHELSKCVNVFTQKPLLSIYLRVHRDEKLYICTKCGKAFIQNSELIMHEKTHTREKPYKCNECGKSFFQVSSLLRH

SEQ ID NO: 789516 - protein, 79 aa, Homo sapiens
MKSLTWILGLWALAACFTPGESQRGPRGPYPPGPLAPPQPFGPGFVPPPPPPPYGPGRIPPPPPAPYGPGIFPPPPPQP

SEQ ID NO: 789517 - protein, 79 aa, Homo sapiens; identical to SEQ ID NO: 789516

SEQ ID NO: 789518 - protein, 82 aa, Homo sapiens
LLLNSRPRRLKAELNIKAGRASHSESWESSALDRTKALEGGTNLVYLRKRKLASPARAQCVAGGEWRRSRDQSGACMSLQRI

SEQ ID NO: 789519 - protein, 122 aa, Homo sapiens
GARQGLERARAAPQSRPHCFRPGTLPRAVRADYARVPVAGGRACGRRLRLSRRRGGGRVGTRARFPPRRAEVGRGRGWRQVAGTWGPGPRVACDGEDAPTALRASSGYDDQPHDRPALAPAE

SEQ ID NO: 789520 - protein, 76 aa, Homo sapiens
EVLVTSSSEPWTAGLPLDVEFSVPFQGGNKAHSTGTGQSWWLMPVIPGLWEAEAGGSLEPRSFKTSVGNMAKPHLY

SEQ ID NO: 789521 - protein, 118 aa, Homo sapiens
VLHHTTPSSYLPHNTHTLTTRSHTLSHSHSQTVTNTLTHAHIHTHAHTHTRSHSHTLTLSHSHSHMLTHSHTHSHMLLFTHIHSHSHIHTRSHTLTLTHIHTHAQVGMMKDGDPLDSG

SEQ ID NO: 789522 - protein, 68 aa, Homo sapiens
MLTFTHKLTHYHTRTITHTHIHTFTHNTFTTLSQHFQICAHVHSQAHMLSQHTLHTLSHTCPLIGALT

SEQ ID NO: 789523 - protein, 104 aa, Homo sapiens
MGGWTDSKVHPPCGRARGSLSLILEVSQASYLPLQRTRPREAVSLGRDGVKLERALGWGRRCPAWLADSSQPGPRAGPVSFTSRRKPGLETPDPPLPSEAQPRP

SEQ ID NO: 789524 - protein, 140 aa, Homo sapiens
RAGREWLGVPGSPLKPRPLLPRAERPPWARPLRSPVLSWLGPDPGSQAAARAGVGKPVAAPLADAPHPARLAPHAGQSRRPGPNPGDYRGPSPRRAARTPGLGAGEGAAVYLVRTPEGAGAAQKAPAQLRRAAQRPLCPT

SEQ ID NO: 789525 - protein, 123 aa, Homo sapiens
QQISSVLVLKQFYEGVCDRIYQGVVEQNICEEAGQYSDGHLQAIQLSCISQCYLERERDINFKELVYVIVEAGKPKIYRAGHRPGTQRSCSLSVKAICWQNSQKISWVYGGIYTTFHSQNGSQ

SEQ ID NO: 789526 - protein, 918 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 789527 - protein, 955 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 789528 - protein, 139 aa, Homo sapiens
AIFLNKNYFAYFLIYSYLTEGMEDLQFENWGPVPKSVIVLTTCITALLDTQESHGNANWKGPLPQGSLRRRGSVESKPTFPKSPPTRPLTPSTVRLYVSGIQGNVNFLFIWEIVHGKQIFFSLVHLLIVYNICTSMQNT

SEQ ID NO: 789529 - protein, 918 aa, Homo sapiens; identical to SEQ ID NO: 789526

SEQ ID NO: 789530 - protein, 918 aa, Homo sapiens; identical to SEQ ID NO: 789526

SEQ ID NO: 789531 - protein, 845 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPLQCWSG

SEQ ID NO: 789532 - protein, 918 aa, Homo sapiens; identical to SEQ ID NO: 789526

SEQ ID NO: 789533 - protein, 918 aa, Homo sapiens; identical to SEQ ID NO: 789526

SEQ ID NO: 789534 - protein, 293 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKVRPGVYFVGKVPGASTSKGTGAAFCWIGCPSHLLKGNEQCHRGPGRS

SEQ ID NO: 789535 - protein, 109 aa, Homo sapiens
ACSTMPGYFFPPGDRILLCCTGWFQTLGLKASLPPWSLKVLELNRIKGVTNCTQLIYDDDDDDDDDDDDDVWEMESLSPRLECNGTISADCNLWLTATSTSWVQLIFVP

SEQ ID NO: 789536 - protein, 70 aa, Homo sapiens
RLQPRNSRSQATALLSVKGSPGPEAERKLRPQLPREPAYSGRHRRERRGRSGFQIPFRKVRLFFITGKGR

SEQ ID NO: 789537 - protein, 164 aa, Homo sapiens
EFITGEKPYECSDCGKSFPSKSQLQMHKRIHTGEKPYICTECGKAFTNRSNLNTHQKSHTGEKSYICAECGKAFTDRSNFNKHQTIHTGEKPYVCADCGRAFIQKSELITHQRIHTTEKPYKCPDCEKSFSKKPHLKVHQRIHTGEKPYICAECGKAFTDRSNF

SEQ ID NO: 789538 - protein, 129 aa, Homo sapiens
QGWRASLKALGPFYPHSRRKVSYAKKRLVGYPRSHAKFCRLYKKHEASILHSWQKEKGSQHFTWQEKRTEKGRGRKHQKIYSLKQENVLSHMICRSGIWSQLRWVLCLGSHKASVKVSSKLGFHLKAHL

SEQ ID NO: 789539 - protein, 118 aa, Homo sapiens
MKPVVPPIGKAPAWCCLSLAASCSDTISILLPRSWISAVLFRVSGQLGSLSCIPAEAPGETANAFVHSIQISYKCEQLLIFRGVFVQLMANPGYLDLQDLLHWAAPRLCVHSPRGPPG

SEQ ID NO: 789540 - protein, 68 aa, Homo sapiens
GPGGHQAAWPSKLQNFPFKEVEKPGDNKRRKKIVNNWSMNDGRWGRSNQKTVHRSESLKEKSDLAKNT

SEQ ID NO: 789541 - protein, 67 aa, Homo sapiens
CQNNMPQDTALPWKNRSTQLGTQILNPRSHGILRALCDFPKNHNCSWKLIFLGQKTVFLRNMETNLG

SEQ ID NO: 789542 - protein, 103 aa, Homo sapiens
WPGMDVYHLVSPSFPRRVGTSHWPDVLSSVESEWRNRGRNQRGRGKSQKRSHILIASCYWLEEEIKFYGWPTLLPIISQVFGGGRKDGIMWRATSFKGGRGEE

SEQ ID NO: 789543 - protein, 88 aa, Homo sapiens
AMTRSVTASAPETSLLCTLGRCGQDKRLPLPIAPDLGLWFRSGKGNCWDFLFLPQPHVAEALFQAGVAKRAQTLFPSAHCHLLEETPL

SEQ ID NO: 789544 - protein, 71 aa, Homo sapiens
NNRDSLSFHSARTRLGSTKSETVKVTEAAVRIDSLESLRQLSGPSCKADKIEIITLVPQQTGLVGTGPLTA

SEQ ID NO: 789545 - protein, 67 aa, Homo sapiens
TPGPAPSRGGSGVALRGRQSPQALQPSGGPWPLAAYSYRPSPGRPWACCGRGAARPELPVERLPEGR

SEQ ID NO: 789546 - protein, 67 aa, Homo sapiens; identical to SEQ ID NO: 789545

SEQ ID NO: 789547 - protein, 269 aa, Homo sapiens
PTRRGSCPPKLDPGVVRRRSLRGDWRDCAEATTGMAVWVLSRLLSAPRLALAKAVLRHVNGQDQIVPGLYACGEAACASVHGANRLGANSLLDLVVFGQACALSIEESCRPGDKVPPIKPNAGEESVMNLDKLRFADGSIRTSELRLSMQKCRWVRVSTTELVSASGAHTWGLESRSKGHRSDRKLGTKLEDTEYSYAVPMRLCLCFSRTEPSRHLKPYHERMLRKRFREDPEDPPSCSMSRLMLRRNPKVVNEAKPVQKPGIHLEVRI

SEQ ID NO: 789548 - protein, 261 aa, Homo sapiens
PTRRGSCPPKLDPGVVRRRSLRGDWRDCAEATTGMAVWVLSRLLSAPRLALAKAVLRHVNGQDQIVPGLYACGEAACASVHGANRLGANSLLDLVVFGQACALSIEESCRPGDKVPPIKPNAGEESVMNLDKLRFADGSIRTSELRLSMQKCRWVRVSTTELVSASGAHTWGLESRSKGHRSDRKLGTKLEDTEYSYAVPMTEPSRHLKPYHERMLRKRFREDPEDPPSCSMSRLMLRRNPKVVNEAKPVQKPGIHLEVRI

SEQ ID NO: 789549 - protein, 67 aa, Homo sapiens; identical to SEQ ID NO: 789545

SEQ ID NO: 789550 - protein, 67 aa, Homo sapiens; identical to SEQ ID NO: 789545

SEQ ID NO: 789551 - protein, 67 aa, Homo sapiens; identical to SEQ ID NO: 789545

SEQ ID NO: 789552 - protein, 67 aa, Homo sapiens; identical to SEQ ID NO: 789545

SEQ ID NO: 789553 - protein, 177 aa, Homo sapiens
VVSLRKDVVEREAFSLTVKAKGLLERYAPVAKDLASSRCGVSVMTLEIRRKDEAVALQKDHVYLQLCHLPPEQLAMRLPWHFQSTAMIFAGVDVTKEPIPVLPTVHYNMGGIPTNYKGRPEAREWPGSDCARPVRLWGGRLCLGTWCQSARGKLALGLGCLWSGMCPEHRRVMQAWR

SEQ ID NO: 789554 - protein, 42 aa, Homo sapiens
FNPVTVRSIICKYRQTDQPGLLCIRPAWVPACVSFVCGSVSL

SEQ ID NO: 789555 - protein, 142 aa, Homo sapiens
PTRRGSCPPKLDPGVVRRRSLRGDWRDCAEATTGMAVWVLSRLLSAPRLALAKAVLRHVNGQDQIVPGLYACGEAACASVHGANRLGANSLLDLVVFGQACALSIEESCRPGDKVPPIKPNAGEESVMNLDKLRFADGSIRT

SEQ ID NO: 789556 - protein, 113 aa, Homo sapiens
MQKCRWVRVSTTELVSASGAHTWGLESRSKGHRSDRKLGTKLEDTEYSYAVPMTEPSRHLKPYHERMLRKRFREDPEDPPSCSMSRLMLRRNPKVVNEAKPVQKPGIHLEVRI

SEQ ID NO: 789557 - protein, 67 aa, Homo sapiens; identical to SEQ ID NO: 789545

SEQ ID NO: 789558 - protein, 67 aa, Homo sapiens; identical to SEQ ID NO: 789545

SEQ ID NO: 789559 - protein, 67 aa, Homo sapiens; identical to SEQ ID NO: 789545

SEQ ID NO: 789560 - protein, 121 aa, Homo sapiens
MQKCRWVRVSTTELVSASGAHTWGLESRSKGHRSDRKLGTKLEDTEYSYAVPMRLCLCFSRTEPSRHLKPYHERMLRKRFREDPEDPPSCSMSRLMLRRNPKVVNEAKPVQKPGIHLEVRI

SEQ ID NO: 789561 - protein, 70 aa, Homo sapiens
GRVHQGPREASEPSHQHWPSRPQSVPPSGAPLGPPGHSRAQLVGASQAQQARPPLPLAPCPLPELRGPGQ

SEQ ID NO: 789562 - protein, 146 aa, Homo sapiens
GVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAP

SEQ ID NO: 789563 - protein, 224 aa, Homo sapiens
RGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVSPSLLSGVH

SEQ ID NO: 789564 - protein, 94 aa, Homo sapiens [sequence omitted]

SEQ ID NO: 789565 - protein, 230 aa, Homo sapiens
PQIYFRYLSFVSFVCSQYILPVCGLSFPSLYVSLVLRFFFWCPGRRRSPTPALPATHAPAPASLPAPCQSPAPPRAAMPLPSSPADRVSRDPISPPHNRPRSHPLTPRLHSSSPNRHTHPPPPYTYLAPTTPPSSRLTPFPHSPTAPSLPLRPPHAPPQRPPPLRPSHHVLSPSPPPRLAPPPRPPHTPLPPPAPPLPTLPATPPSHPPSPPPRPSAPPLSPLSPAPPPP

SEQ ID NO: 789566 - protein, 146 aa, Homo sapiens
MPLHSSLADTASLTLHLNHTNPSRDQPLTPLPQYISHARTLSLVQILPHLPSTLSRSLTLLIFTPRPLAYLLTTSPLPTPPFFALPLTTPLHPSSSFPSPPIFLLHPASPSLPHRPPSSLLSPPAPLASRPSPPLRPLSALPPSSP

SEQ ID NO: 789567 - protein, 103 aa, Homo sapiens
MALWTAARPPSKPCAPRARPKITQLSATHSGGDQKPRGAVFTRLLSHTALMEKVGPWHVGPRREKTPLYRRFWKEAVRLALTSQLFPTSSFTLQRKPECLLIP

SEQ ID NO: 789568 - protein, 82 aa, Homo sapiens
PSRSEERPVKKRKVQSCHLQKKQLRLLEAMVEEQRRLSRAVEETCREVRRVLDQQHILQVQSLQLQERMMSLLERIITKSSV

SEQ ID NO: 789569 - protein, 124 aa, Homo sapiens
SRRLPCGDEAIRWLVSKKGEAALYRNGLLPTQQKPCVHLFLNHALMSLEISHGEGKSMWKSANTIEDFFSLPCPFPFSSFLHFFLSSSSSSSSSSSFFSLFFYNIIYTYLLFISKVVDKHLPAH

SEQ ID NO: 789570 - protein, 68 aa, Homo sapiens
SNSGFKGKGKRRALNLKIKSKQNKTSLTNLYGSSSLFSSWIFIILIHLLLCLVKSQITTSIYQLVTVS

SEQ ID NO: 789571 - protein, 82 aa, Homo sapiens
HKTAISHPGEGPQAVGTLVPSGAGSQLINEPFVAELSAGSGHSAILQQATDHHKALAHLGALIQHRYLNTQYVNSRFRTSWT

SEQ ID NO: 789572 - protein, 73 aa, Homo sapiens
DEIKGLFSGETERPQKKRPPKADIWKSSNKRTAFQPSNLIVKPTTWQAPPAHRVSKQLGSVMGTNLGTPAKNP

SEQ ID NO: 789573 - protein, 149 aa, Homo sapiens
PGSGQESSGRTDSLGGTDFLGPQKGPSFFLCLSLSFLSPCLPSLSSTPPWRISSQPLAHVSPTVVFFGGNVVAGRWARKCTLSSPSLRSSNSGQAGDACPSPPQTCPTIRLSRLCSGKKRRGPLPLCLLPLGPALTGGTQEDAHREGGK

SEQ ID NO: 789574 - protein, 80 aa, Homo sapiens
ESSFQDLKLPPIKELNEEWKENSLFANVLEPVLDRDRWSWDRHHVDFDLYKKPPPFLELLPSPAPKPVTVRKKKGNSPIS

SEQ ID NO: 789575 - protein, 619 aa, Homo sapiens
MPAQRGKKRRRERRDRFSWPHAIFIGSSLERYSTNSPNYRIFSTRSTIKLEYEGTLFTEWSVPETCFVLNKSSPTTELRCSSPGVHAIKPIVTGPDEEERYLFVESSHTCFLWYYRVRLKEEEAPLQSGQKMKFTSDPFFLSLPDLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPEVRETLPSRLFIWNN

SEQ ID NO: 789576 - protein, 293 aa, Homo sapiens
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILS

SEQ ID NO: 789577 - protein, 142 aa, Homo sapiens
MATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILS

SEQ ID NO: 789578 - protein, 223 aa, Homo sapiens
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILS

SEQ ID NO: 789579 - protein, 134 aa, Homo sapiens
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVSLSLCGHMIQKVQILMSCWGMQKNLQ

SEQ ID NO: 789580 - protein, 106 aa, Homo sapiens
MQWHGLGSLQPPPPGFKRFLYFSLPSSWDYRRMLPCPADFFFFVFFCRDRISQCWLGWSQTPDLKQSTHLASQSAGIIGVSHRAWPVNSYVVTFHIFIYVYTNCPL

SEQ ID NO: 789581 - protein, 126 aa, Homo sapiens
GLELLTSGDLPTSASQNAGITSMSYCTWSETAILIVSSLRKKKLSGKNMLLYLEPWTFNYNSKTLWIIYKGTKKGLNLLKIMKVVNDRRLARAKHSCLWYSAIRPQLCLCSNSLPLHLRINGTEKI

SEQ ID NO: 789582 - protein, 102 aa, Homo sapiens
MAWQRSWWNWTAVWERRGGQGRQGPHRQLQPGPDDCKGSHAGSGTHTGRAPCHSPHTSPSLSHSPTSSETEGKLRPQEVALGPSSHRDCRGLDPASPAPEPA

SEQ ID NO: 789583 - protein, 543 aa, Homo sapiens
IRLNTKEDKNGVPDLVALLAVRDTPDEEPVDSDTSESDSQESGDQETEELDNPEFVAIVAYTDPSDPWAREEMLKIASVIESLGWSDEKDKRDPLRQVLSVMSKDTNGTRVKVEEAGREVDAVVLRKAGDDGDLRECISTLAQPDLPPQAKKAGRGLFGGWSEHREDEGGLLELVALLAAQDMAEVMKEEKENAWEGGKYKYPKGKLGEVLALLAARENMGSNEGSEEASDEQSEEESEDTESEASEPEDRASRKPRAKRARTAPRGLTPAGAPPTASGARKTRAGGRGRGRGVTPEKKAGSRGSAQDDAAGSRKKKGSAGAGAHARAGEAKGQAPTGSKAARGKKARRGRRLPPKCRCGPPRSRPGCEQAPQGTRPPVAPALPSPLPVLRRRNLLASQRARAAFCQRHVPLSGPRRPGAPAIPTEEARMGGGKRSGRPRQQRRAEMGTRQVDQDWGPGLPPEGVCVWTPGTCRGEQGSSWRSRGLRLAGAVGRCRPYPSLTGPWVCGGGSVTSRAARVRAQLSARGGPSSQPGEEMIPERKV

SEQ ID NO: 789584 - protein, 543 aa, Homo sapiens; identical to SEQ ID NO: 789583

SEQ ID NO: 789585 - protein, 113 aa, Homo sapiens [sequence omitted]

SEQ ID NO: 789586 - protein, 113 aa, Homo sapiens [sequence omitted]

SEQ ID NO: 789587 - protein, 180 aa, Homo sapiens
HTHSHTHKNTDSHTHGQTQTHTQTHTDTQTHTQTDTHTDTQTHTHKLTQTHKYTDSDSNTNSHKHIYTNSQTHTHKHTHKHANLHTHEQTHTRPFWALLFLLHRKPCKVSPDLSSKARSGQPHRNPAITIPRAPLCSQMPPVPMPHASPPLYLLCPGSLEHFPPGRILIIIHGSSVMSFL

SEQ ID NO: 789588 - protein, 155 aa, Homo sapiens
ARSICEAPSTSISVWRPQSGWVRQAERGMTSRGDEPRRVAGPGKGREGRGEPEPLLVQRGSSQNPGKRALPGELCQLTEKEPEIWTSLSHPRPGSLWAGSHSVWKQASSGVSAGWRWRGWPGRACRARRHRVHSGRGGPGSAIATEPHLDTHHWL

SEQ ID NO: 789589 - protein, 180 aa, Homo sapiens
VALTRARPGQVSSYMATVSGLLKIVQAFVACIIFGALVHDSRYGRYVATQWCVAVYSLCFLATVAVVALSVMGHTGGLGCPFDRLVVVYTFLAVLLYLSAAVIWPVFCFDPKYGEPKRPPNCARGSCPWDSQLVVAIFTYVNLLLYVVDLAYSQLQQCPAGICALWASVALGGSPAEGGR

SEQ ID NO: 789590 - protein, 117 aa, Homo sapiens
MAPTGVSEAWVGGGAAPSWGGQCLVRPHWPHVAPLLTRPTWPVTSASGPSSSVDPQLPPFLTLLLSQHRFPIGHLQEKSVVKFPTLPRTHPSGILVYSLAPPNQPAETQPPNSASRN

SEQ ID NO: 789591 - protein, 149 aa, Homo sapiens
KKKSPKTKPQPPPYHLQIQSAEKQPRVPTRGSLAGCVIWALPSATRYFPARPPAPSGFQGCAPAGWSREVESRQRGVASLSPPHASPPPTPDTTTSHGWEHWGPPNPARGARPQAGEEASELKGRPFLPPPALAPATAVGAASRNLGRP

SEQ ID NO: 789592 - protein, 121 aa, Homo sapiens
PQNLARERKNLRLGTVSPFLPPFLLKCSWLRKDGEGRNFHLGSFSPMRESGQRGGEPGSSRVGQEGEQGNQDKEEDRQVAPEQAGRESESFKGALPQWPRHSVPPCVCSLAGLDPSQANFN

SEQ ID NO: 789593 - protein, 128 aa, Homo sapiens [sequence omitted]

SEQ ID NO: 789594 - protein, 77 aa, Homo sapiens
GVLTFRDVALEFSLEEWQCLDTAQQNLYRNVMLENYRNLVFVGIAASKPDLITCLEQGKEPWNVKRHEMVTEPPGLQ

SEQ ID NO: 789595 - protein, 128 aa, Homo sapiens
LYSSIPHIYLNFFLVFITDLVHLEVIPRSFSSVQGLFLVGVWYSGVLRAQSLLHHDPFVIICKLDPVELFKTLSPVFRLACAFQWVGSVLRAVRNPVSYLASASLLTSLVVVRALFLSNYMQWFMVLL

SEQ ID NO: 789596 - protein, 72 aa, Homo sapiens
CTSSLLLSPEIYDMAVCASLASGMYKATVPACGTHTQSSHRNRVLVAFYHGGKVWHRKKQVLTDRGITWEDS

SEQ ID NO: 789597 - protein, 110 aa, Homo sapiens
CGVVACLSAPTVGAWATIAALAWLMSLIEPTSHLLDLEGEGRGKAWRLTKRKEFSNGRSEPRSPKVSGLFFPPSHVTPLIQHLSFLFLSFFFFFWVISATLNVGERVIYS

SEQ ID NO: 789598 - protein, 71 aa, Homo sapiens
GRVRHCLVCEVSGAPGVCLECSRRCVSGSEWMSVRLWSVRGCVALSGSSASLGVSGGLSRGLAQECVSPSL

SEQ ID NO: 789599 - protein, 166 aa, Homo sapiens
MGTRTFSAFHVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDAIKLMKDISQNFPIKARSLTRIAVNQHMR

SEQ ID NO: 789600 - protein, 567 aa, Homo sapiens
MSVLSFWLAILLSPEYNNRTYRIDDVDWNKTPKDSFTMSDGKEITFLEYYSKNYGITVKEEDQPLLIHRPSERQDNHGMLLKGEILLLPELSFMTGIPEKMKKDFRAMKDLAQQINLSPKQHHSALECLLQRIAKNEAATNELMRWGLRLQKDVHKIEGRVLPMERINLKNTSFITSQELNWVKEVTRDPSILTIPMHFWALFYPKRAMDQARELVNMLEKIAGPIGMRMSPPAWVELKDDRIETYVRTIQSTLGAEGKIQMVVCIIMGPRDDLYGAINKLCCVQSPVPSQVVNVRTIGQPTRLRSVAQKILLQINCKLGGELWGVDIPLKQLMVIGMDVYHDPSRGMRSVVGFVASINLTLTKWYSRVVFQMPHQEIVDSLKLCLVGSLKKFYEVNHCLPEKIVVYRDGVSDGQLKTVANYEIPQLQKCFEAFENYQPKMVVFVVQKKISTNLYLAAPQNFVTPTPGTVVDHTITSCEWVDFYLLAHHVRQGCGIPTHYVCVLNTANLSPDHMQRLTFKLCHMYWNWPGTIRVPAPCKYAHKLAFLSGHILHHEPAIQLCENLFFL

SEQ ID NO: 789601 - protein, 198 aa, Homo sapiens
MRVGLSLTVVREPEGSVSHTSSLSFQVNHCLPEKIVVYRDGVSDGQLKTVANYEIPQLQKCFEAFENYQPKMVVFVVQKKISTNLYLAAPQNFVTPTPGTVVDHTITSCEWVDFYLLAHHVRQGCGIPTHYVCVLNTANLSPDHMQRLTFKLCHMYWNWPGTIRVPAPCKYAHKLAFLSGHILHHEPAIQLCENLFFL

SEQ ID NO: 789602 - protein, 38 aa, Homo sapiens
CLAFSAILDSAERSPHILKLGTHPRSVPVPSNMRKRLM

SEQ ID NO: 789603 - protein, 175 aa, Homo sapiens
GGGASGSLGGCFYPRSSADLPFQTTRCEFQTSVMELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLL

SEQ ID NO: 789604 - protein, 104 aa, Homo sapiens
RPTHRDGANLSLNDNAGLVTNWFNSRPWVGPLVCALIMENLSPWKKLLDQVRLVAGRVRMTTCYTIKMFLDQCTDRSIALLSVVTKIVVFEEKDTCLENTRKVF

SEQ ID NO: 789605 - protein, 105 aa, Homo sapiens
GDSLALLPRLECSSDLGSLQPLPPGFKRFSCLNLPSIWDYRHVPLHPANFCTKTRFHHIGQSSLKLLTSGDMPASDSQSAGITGMSYGARPRSGVLEGVTMICFY

SEQ ID NO: 789606 - protein, 126 aa, Homo sapiens
MEQSPLGEKPVFCCLPDTGWLRNNRGGQSRQHLCGPRTQEGLALAYREGGQAQQSCPPKEHQWPLVPRPTGRLELWVTFVERDTDSGRDRDVVIQAVWHKKIKRPPSPGPLPWTSWYRASIFSSVQ

SEQ ID NO: 789607 - protein, 118 aa, Homo sapiens
KKFIRHQSDRYVKIKRNRRKPRGIDNRVRGRFKGEILMPNIDYGSNKKTKHMLPSGFRKFLVHTSRSWKCCCCATNLTVLRSLTMFPPRTAKPSWKRAAQLAVRVTNPNPRLRSKENE

SEQ ID NO: 789608 - protein, 144 aa, Homo sapiens
ISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMD

SEQ ID NO: 789609 - protein, 140 aa, Homo sapiens
LQRLPHLTSLQLPSLLLQGRATQGRMGGGGSSAHSQKPPWLPDWGSSLCPQKAQITLLGPQTSCFALGTLHLPCNTISFWKAWTTWGGVASKSLRDPTLPSLWELPSSLSKQPRLPGFAYILCPQEVFSAPSWGLGRRGS

SEQ ID NO: 789610 - protein, 42 aa, Homo sapiens
MLKTESSGERTTLRSASPHRNAYRTEFQALKSTFDKPKSDGE

SEQ ID NO: 789611 - protein, 118 aa, Homo sapiens
MLLQDEIAALPLFPNPGKTYSEHQSLNTATELHCCSTTVSQTGENFSGHWNLIMAVSCFYPGKVPCKHLGFVESLGLRLSHRLSPYSSMASASLFNVVSQVIGVLSSHKDPHTCHCNH

SEQ ID NO: 789612 - protein, 190 aa, Homo sapiens
PSTERLLQKVIPFVLWTPGPQGFWSLGSTGASGPAGVWQRLQSRCPPWSVLSLEVTAEPLSALVCPFTQGHFVLGVFFAISTIHLTGFFGDVLSVCVFTDLALVTCGFRPCLVSGIFSSIRSLTQLFSSLAVGPRDAAAALMSSLPPSLLSLPLLSSGFTVVFQNPASIIGAFVALSVVFLAVNKIFCDF

SEQ ID NO: 789613 - protein, 40 aa, Homo sapiens
MYFPQIIINQYFGHTSYKNLKLAKTTLLFSLHSTSPRVVT

SEQ ID NO: 789614 - protein, 116 aa, Homo sapiens
FIVTSPELNCCQKDYARVASSRSGQWRRWTLTDVSMAGRLQGLETWPRSSRGLPDHMLHMGLVSVAGLGGDGAVEVTELTVWAPGPLALWVWVLGDAGIWSSVPPNYVDTLGPQRL

SEQ ID NO: 789615 - protein, 86 aa, Homo sapiens
VQRNQRWIPHVALGRTSVKSTNVQGMALVERGPLLLLTDQVVLWSGPGSSSLQKPFITPKQHLHPVIQAQGETTELAGRRGHVSRE

SEQ ID NO: 789616 - protein, 34 aa, Homo sapiens
MLTNFWWQRDCVSTTSGIMRAALQGARQPRREAA

SEQ ID NO: 789617 - protein, 115 aa, Homo sapiens
MVLGQQEGAADDKESRGRTTAWGGLGSGGAREWGQESVAGKRKFNRENREEAEIGRARNRQNGNWGQSKIGHKEEQGVKQIARMEQNKWKRRNRGKRGRNSRRGEGQKNKPILMG

SEQ ID NO: 789618 - protein, 202 aa, Homo sapiens
FTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNYTVLVEQQTPDPRWGAFAQSILERGGPTPRNGNKSDQAHPAPKC

SEQ ID NO: 789619 - protein, 163 aa, Homo sapiens
MKEFSSTAQGNTEVIHTGTLQRHESHHIRDFCFQEIEKDIHNFEFQWQEEERNGHEAPMTEIKELTGSTDRHDQRHAGNKPIKDQLGSSFHSHLPELHIFQPEWKIGNQVEKSIINASLILTSQRISCSPKTRISNNYGNNSLHSSLPIQKLGSTHERKIFPM

SEQ ID NO: 789620 - protein, 237 aa, Homo sapiens
MNTIKQLESRIEELNKEVKASRDQLIAQDVTAKNAVQQLHKEMAQRMEQANKKCEEARQEKEAMVMKYVRGEKESLDLRKEKETLEKKLRDANKELEKNTNKIKQLSQEKGRLHQLYETKEGETTRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKEL

SEQ ID NO: 789621 - protein, 276 aa, Homo sapiens
IFRLIKENKKHQELFVDICSEKDNLREELKKRTETEKQHMNTIKQLESRIEELNKEVKASRDQLIAQDVTAKNAVQQLHKEMAQRMEQANKKCEEARQEKEAMVMKYVRGEKESLDLRKEKETLEKKLRDANKELEKNTNKIKQLSQEKGRLHQLYETKEGETTRLIREIDKLKEDINSHVIKVKWAQNKLKAEMDSHKETKDKLKETTTKLTQAKEEADQIRKNCQDMIKTYQESEEIKSNELDAKLRVTKGELEKQMQEKSDQLEMHHAKIKEL

SEQ ID NO: 789622 - protein, 184 aa, Homo sapiens
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 789623 - protein, 91 aa, Homo sapiens
SSHNVEATRKGFLVPVLKAVTFSAHLYNADSPGTSLSRVVLRIKSDNAHGNTLQMEVLLFFQVCKERQRQCSCSVSEFHVTYIGLLYKSCN

SEQ ID NO: 789624 - protein, 72 aa, Homo sapiens
NSRTRLIIPTRKECSHSQIPGTDFAIIPVPGDLGKIGFLFCFVLLYLEEGSRSVTQAGVWWQEHSTWTPTFK

SEQ ID NO: 789625 - protein, 68 aa, Homo sapiens
RNDPNIAIITIIPQNPLTHDALPSRVNPQSGSHPSTSLLPCCLGGQSGQLAVSKTARNAHSAPRPWML

SEQ ID NO: 789626 - protein, 110 aa, Homo sapiens
HKHTPNTYTHPKHTHIQNIHTYTHPEYTHIQNTHTHTYQDDYLAFCNLLFQSTIYVGKNILMSMNYNIYYAPCGLHKFPLFKQFPVLSFKQYPDDTLIYHLHSSLITSGK

SEQ ID NO: 789627 - protein, 76 aa, Homo sapiens
CRLHEDGMGLGAPLSKEQVGSECATDWPGLWPPGNPHPDCPLYLFVASSGALFEDLSVCLCCSPHLFPCLFLVSFL

SEQ ID NO: 789628 - protein, 31 aa, Homo sapiens
MPDAAKKGVVKAEKSKKKKEEEEDEEDEEDE

SEQ ID NO: 789629 - protein, 54 aa, Homo sapiens
YEKKAAKLKEKYEKDIAAYRAKGKPDAAKKGVVKAEKSKKKKEEEEDEEDEEDE

SEQ ID NO: 789630 - protein, 96 aa, Homo sapiens
GYGPTEDVQGLRAAICIRWGRESGPGLCAQQPRQCHPPPVTQPALLPRSQARKGLPITGSRTSCHPKGPGSRCGPLFPPRPTLPHRRHLPGFAIQC

SEQ ID NO: 789631 - protein, 105 aa, Homo sapiens
INLESRIVSLWTTLNCSGIILAHRNLRFSGGSSDSSASASQSCEVTGVSHCAWPTFLINLLSLYPMDSSRILSCARAKNPFLGSESGPLSANFTNYHRWSPLITR

SEQ ID NO: 789632 - protein, 253 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLKFHFFSCLWRTYVIRF

SEQ ID NO: 789633 - protein, 118 aa, Homo sapiens
MIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIRRGREFSSSRRP

SEQ ID NO: 789634 - protein, 243 aa, Homo sapiens
KSAAASTESVYFSFSVIFRFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLKFHFFSCLWRTYVIRF

SEQ ID NO: 789635 - protein, 232 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSRRGREFSSSRRP

SEQ ID NO: 789636 - protein, 189 aa, Homo sapiens
MIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLKFHFFSCLWRTYVIRF

SEQ ID NO: 789637 - protein, 207 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRSVSKALRAKDVSTMFLSST

SEQ ID NO: 789638 - protein, 182 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIRRGREFSSSRRP

SEQ ID NO: 789639 - protein, 149 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFTS

SEQ ID NO: 789640 - protein, 117 aa, Homo sapiens
KSAAASTESVYFSFSVIFRFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFSL

SEQ ID NO: 789641 - protein, 207 aa, Homo sapiens
PTTTKFAAASTSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLKFHFFSCLWRTYVIRF

SEQ ID NO: 789642 - protein, 205 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHSTRPRI

SEQ ID NO: 789643 - protein, 200 aa, Homo sapiens
TFLCFPPFSVFLAIFHILKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRHIPGPSVCISHFSRFLVISSFFKSSSGCFSFSMIFSFLAIFHVLQWTFLNFPPFSVFLAIFHVLKCVFLIFRDFQFSRDAAANLVVVGGR

SEQ ID NO: 789644 - protein, 67 aa, Homo sapiens
PTTTKFAAASTSDFVIFQVVKWMFLIFHDFQFSCHIPRPTVDISKFSTFFSFPRHISRPKVCISHFP

SEQ ID NO: 789645 - protein, 123 aa, Homo sapiens
GQCQHCTSLGRRLFRWLIPQEDSVRYRCRGSGRTVPRHSVRSGSKAGRQRQHWPGRCSWRPPSHQGPTSPAAYPILELGTLGASDLHVATGAAVSGPLSGTAVCLQYKDCPVSVQGPVGRAGN

SEQ ID NO: 789646 - protein, 77 aa, Homo sapiens
MAKQPSPLGPGFGWYALQNSCLGLSLPLLRRTVCRDPLLHLPLLWPECRWDLGPLRTRPEDLQTHLPLRGPWEVWFL

SEQ ID NO: 789647 - protein, 158 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQETSELAHIVEK

SEQ ID NO: 789648 - protein, 171 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALGDLRACTYCRKIALSYAHSTDSNSIGEDLNALSDSACSVSVLDPSEPRTPVGSRKASRNIFLED

SEQ ID NO: 789649 - protein, 183 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLC

SEQ ID NO: 789650 - protein, 53 aa, Homo sapiens
MRTHDAYSGPSMAQSACTSSLLKPMKTLDSATHRDIESTCMWKGATHCQSPEG

SEQ ID NO: 789651 - protein, 130 aa, Homo sapiens
SDRLHHTYPTYTVSWLQRLPTVSFHSILDSPIGSQVHMIAPQVLVTIPIIWGPIKENCQHEYMKLLSMNNTNSWLDRDYICLHTTWEFKITMIYTHSLFLSCKRSLHRDIILVHGFYLQGHLALVGMMKD

SEQ ID NO: 789652 - protein, 113 aa, Homo sapiens
ISSWEMTLPQHTQAGCEKRASPPWLSKGDAPLQLNLEPADPKVPVSLGPTSSCMVWSAIPPSSPRQPSRHPGLQGQVEARERSDTGHDPIHSKKQNPNLTSPQQHSFCSAIPR

SEQ ID NO: 789653 - protein, 280 aa, Homo sapiens
MSRQQKQQQQQQPSAVRGRRMTEPAMAIVDAAEVELKEEDKEPLIELFVKAGSDGDKHRKLPLFSEALHASDSSQGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 789654 - protein, 128 aa, Homo sapiens
NKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 789655 - protein, 103 aa, Homo sapiens
PYGCALRSWRPYPNLLSISATRLGPETRELSLCPPAFGLSPNKPFVHQKYLLSAYHVPDKGDVTVRKNRVSLSATQARVQLTQGRGAPKWSIACPELVGSWSH

SEQ ID NO: 789656 - protein, 133 aa, Homo sapiens
MRPGSPSRTGFFQLVEEEEELGEEEELGEEEELGEEEEEEFEEEKEEEEFEEEEEGEEGEEEEEGEGEEEEEGEEEDYEGEEEVYEREEDYEGEEEDYEGVEEGCEEEEEDEDKEEDEEEAEDEDKEEKEKDN

SEQ ID NO: 789657 - protein, 787 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 789658 - protein, 787 aa, Homo sapiens; identical to SEQ ID NO: 789657

SEQ ID NO: 789659 - protein, 604 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 789660 - protein, 117 aa, Homo sapiens
MYPSYGQIIYGERVTSWYKLALRLWIGIITLKLHGPLCQAVEYLVLGPLDESLGINSASPRIIYLLSLMCTYLMKIPTKMMGCFGEMSVEKESRVMVLGIHGLCSACPGRSAKEAMI

SEQ ID NO: 789661 - protein, 601 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENFPGRNYALWQWFDGPPFLPPLIPLTPLLLPISPFILIIL

SEQ ID NO: 789662 - protein, 787 aa, Homo sapiens; identical to SEQ ID NO: 789657

SEQ ID NO: 789663 - protein, 787 aa, Homo sapiens; identical to SEQ ID NO: 789657

SEQ ID NO: 789664 - protein, 693 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATA

SEQ ID NO: 789665 - protein, 35 aa, Homo sapiens
MVQSEAMTEAAGLCQHWRPSDTVWLVTTGGGRVQV

SEQ ID NO: 789666 - protein, 78 aa, Homo sapiens
RRGKDYKAGERRMTMMYDEFRVGFLYRESWDGLQDRLGYSGVDYYYYYICGRVDHTSVIPATQEAEEGESLVPRRRLQ

SEQ ID NO: 789667 - protein, 79 aa, Homo sapiens
ESSLLEEETPGGSRGHPSAAMLRLTLRRTPTVTSNTCRTQPPTWGQIKKLSQMAEENLRKGGSGKNESYTSPVVSDTPT

SEQ ID NO: 789668 - protein, 104 aa, Homo sapiens
AELKACRDQEEEYKSKYEEEAHRRATLENDFVVLKKDVDAVFLSKMELEGKLEALREYLYFLKHLNEEVRLNQRAGCSQERGLGGQASCGHEENGQEGKSVRVA

SEQ ID NO: 789669 - protein, 28 aa, Homo sapiens
MLIETETEPLQCLFNDAKEDSKDKSIAY

SEQ ID NO: 789670 - protein, 83 aa, Homo sapiens
QPPLPPQPCFQLVSGLGFSPRPLWVSSKPAKRLLVAESWLCQHPLKVHICTPALHHLGGYISSRFRWGGQSQDWPLGVRSLRL

SEQ ID NO: 789671 - protein, 72 aa, Homo sapiens
QIKPLHPSPASVDTTSSTSPASVDTLLSQQVKQAEASAGPRSRSRESQVSVFRFCLLTPHPRKTNPSEFYRM

SEQ ID NO: 789672 - protein, 104 aa, Homo sapiens
MGISRPPAPVLELCRVNEADVEELAPPTAALWSRGPRKIRWTQGQAAWICPPPCYAMTTSEPHTRPEFWAHLKPGIAINIFNLQKEKKKAGVVAHTCNPSTFRG

SEQ ID NO: 789673 - protein, 137 aa, Homo sapiens
PSAWLLSSRESQGQLASSPKGDGLSAQCQSPAPGGKFRSAEGVGAAGGEESPLLVCSAVAASQGPLVPKRTAAGGTSALQAGWVPGPGPRRALEARPQAGEELLSRAVAVGPHCLQELSGIGRGRTGSRFHWDSSRV

SEQ ID NO: 789674 - protein, 192 aa, Homo sapiens
MSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMAVLKRHCVDG

SEQ ID NO: 789675 - protein, 229 aa, Homo sapiens
DSAFSMSDCCSAPGISWEAGVGRPAVPGLELQIRRGAMSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMAVLKRHCVDG

SEQ ID NO: 789676 - protein, 120 aa, Homo sapiens
CATAQYGWWWGQPITTLTPVRLEDWGSKHMLWYTITQRGGADGQEARGPGAAVPANHQTPTSPEIGPLDSGPEMAIKKSSFLGGGQRPLGRYDVPAAMCEGGPTLPTGTDVTEQRLTMED

SEQ ID NO: 789677 - protein, 308 aa, Homo sapiens
SGRQVGGSKMAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 789678 - protein, 279 aa, Homo sapiens
SGRQVGGSKMAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQVRPLAFCPLVLST

SEQ ID NO: 789679 - protein, 271 aa, Homo sapiens
ADGKSEVARWPPLRKAVVSGPKRTGNWRSFWKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 789680 - protein, 46 aa, Homo sapiens
MPPPQPIPAEQPSRLRTKGRGVPSSPYLLSWTRLTFPAAPMGSPPA

SEQ ID NO: 789681 - protein, 44 aa, Homo sapiens
MNHPKPGASKQHTLTLPQFWRRPKSRCRQDAFLVEALAEDLFQP

SEQ ID NO: 789682 - protein, 108 aa, Homo sapiens
TAPSPGSDFLFLRKRNSRTQIDTHLELLEFSKHTTVETIIVIMMGLSYIWGALGSLQHGFKQIMSLESHNISLRSSELALLLPSSTPFIDRKTEDPRAYVSCLGTHGQ

SEQ ID NO: 789683 - protein, 73 aa, Homo sapiens
HLGKLLKPKTCHPWLHLSKITTSDPSANPADSAFKLSLSVDPAIQARIIFCLNQRKILLPGLPVSVLIQYTLY

SEQ ID NO: 789684 - protein, 105 aa, Homo sapiens
SGDSRCWQGCGEREHSSLFWDCKLVQPLWKSVWRFLRKLDIVLPEDPAIPLLGIYPEDVPTGKKDTCSTMFISAIFIIARSWKLPRCPSTEEWIQKKCGTFTQWS

SEQ ID NO: 789685 - protein, 84 aa, Homo sapiens
ARAFQVPRRPGHAARRQFSVKMPETFNPQLPGLYGSAGRGSRYLRTNSKTEVTVVKRGRGALEAWAGVLSARRSLRPQGEERLP

SEQ ID NO: 789686 - protein, 132 aa, Homo sapiens [sequence omitted]

SEQ ID NO: 789687 - protein, 198 aa, Homo sapiens
SSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVVPDGPWRRSSSQDEERTEAQRTPKRRWGSGRRPRPRPFSDYGQLASRSLSIPEDSVAADPQ

SEQ ID NO: 789688 - protein, 200 aa, Homo sapiens
SSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVRAAARSLMWATLLREGSLHRCCPWSLTCQGQWPSADLVALTVLVGMGVVKLLFTKFRSNLYLL

SEQ ID NO: 789689 - protein, 85 aa, Homo sapiens
SFTTADPSADGQADSPLLGARGLPVPVPLACLPGPLSVRPGVPGVFGWTRGCASAWANADATVRVCQTSVPQKSAGVRAHPCTRM

SEQ ID NO: 789690 - protein, 102 aa, Homo sapiens
RHSTGLLGKGPLKTFDLPLPSRPSVSEPQKPVHEGLGSLCDPGVGPHERPLLFPRTLPSSPSKSLSQLSPSALILLQEALFILFSSVSSIFHVLMIFFSKCC

SEQ ID NO: 789691 - protein, 374 aa, Homo sapiens
MAAPPRPAPSPPAPRRLDTSDVLQQIMAITDQSLDEAQARKHALNCHRMKPALFSVLCEIKEKTVVSIRGIQDEDPPDAQLLRLDNMLLAEGVCRPEKRGRGGAVARAGTATPGGCPNDNSIEHSDYRAKLSQIRQIYHSELEKYEQACREFTTHVTNLLQEQSRMRPVSPKEIERMVGAIHGKFSAIQMQLKQSTCEAVMTLRSRLLDARRKRRNFSKQATEVLNEYFYSHLNNPYPSEEAKEELARKGGLTISQVSNWFGNKRIRYKKNMGKFQEEATIYTGKTAVDTTEVGVPGNHASCLSTPSSGSSGPFPLPSAGDAFLTLRTLASLQPPPGGGCLQSQAQGSWQGATPQPATASPAGDPGSINSSTSN

SEQ ID NO: 789692 - protein, 209 aa, Homo sapiens
MRPVSPKEIERMVGAIHGKFSAIQMQLKQSTCEAVMTLRSRLLDARRKRRNFSKQATEVLNEYFYSHLNNPYPSEEAKEELARKGGLTISQVSNWFGNKRIRYKKNMGKFQEEATIYTGKTAVDTTEVGVPGNHASCLSTPSSGSSGPFPLPSAGDAFLTLRTLASLQPPPGGGCLQSQAQGSWQGATPQPATASPAGDPGSINSSTSN

SEQ ID NO: 789693 - protein, 209 aa, Homo sapiens; identical to SEQ ID NO: 789692

SEQ ID NO: 789694 - protein, 145 aa, Homo sapiens
MRPVSPKEIERMVGAIHGKFSAIQMQLKQSTCEAVMTLRSRLLDARRKRRNFSKQATEVLNEYFYSHLNNPYPSEEAKEELARKGGLTISQVSNWFGNKRIRYKKNMGKFQEEATIYTGKTAVDTTEVGVPGNHASCLSTPSSGE

SEQ ID NO: 789695 - protein, 76 aa, Homo sapiens
QSRKHHITQLQTINRRVEITKIDMVLVQKHKHIDQCNRIENPEIKLHTNSHIIFNKGNLSNGEKTPYSINGARIAV

SEQ ID NO: 789696 - protein, 117 aa, Homo sapiens
SDKSQGSWRSQPGMRGPLRLPCPVLKLSPESCVSVAQAVPSCARLRTVRNNTQNFKEIKHSNKGFLAKQFYFCTEGCLSLASRHESTPEQRDTRAFIPDASPAPVPSPHWPGSGHTI

SEQ ID NO: 789697 - protein, 101 aa, Homo sapiens
MKTAGSQEHEESVCVYVYVVCVYVVCVYVCNVCMLCVCIVCLCVCKGGAPGEDGRVGRAVVCVSGEKERPLALTCSAGITAVYVVCVCLCVVCVWCVCKSY

SEQ ID NO: 789698 - protein, 110 aa, Homo sapiens
VTRQNMSPASSCQGEPVSVHWDGQSLFTNSLGESVTNNPVSTLSYCLLNMMCVRQLANTAINPGVPHISDENTEAQLRWLLQSDSEVAGDSHICGAESQCLCSLSLCQML

SEQ ID NO: 789699 - protein, 63 aa, Homo sapiens
MRTNAGRVLTPRPSPPCALCTCSMPRLHISSGCLSRCSSPFSMLFCTPGNSLAGSTPRGSCPL

SEQ ID NO: 789700 - protein, 215 aa, Homo sapiens
MDKVQSGFLILFLFLMECQLHLCLPYADGLHPTGNITGLPGSKRSQPPRNITKEPKVFFHKTQLPGIQGAASRSTAASPTNPMKFLRNKAIIRHRPALVKVILISSVAFSIALICGMAISYMIYRLAQAEERQQLESLYKNLRIPLLGDEEEGSEDEGESTHLLPENENELEKFIHSVIISKRSKNIKKKLKEEQNSVTENKTKNASHNGKMEDL

SEQ ID NO: 789701 - protein, 111 aa, Homo sapiens
LVNCTQATCRTLSPEIPTGGGKSKQLRSHPEFSTHFWGDLGRNVGMLHPLIFFSRCCSSAQRGTEHCGIFNLHQCSLPKHQMSLLAMLHPCSYPPCLPSFSSFCLHRTRQP

SEQ ID NO: 789702 - protein, 148 aa, Homo sapiens [sequence omitted]

SEQ ID NO: 789703 - protein, 272 aa, Homo sapiens
MDAGVTESGLNVTLTIRLLMHGKEVGSIIGKKGESVKRIREESGARINISEGNCPERIITLTGPPMPSFKAFAMIIDKLEEDINSSMTNKYRGSRPPVTLRLVVPATQCGSLIGKGGCKIKEIRESTGAQVQVAGDMLANFTERAITIRWRARSLVTEWWFKQICLVMLETLSQSPQGRVMTIPYQPTAGSSPVICAGGKIGGSDAAGYPHATHDLEGPPLDAYSISGQHTISPSIWQAEPVGDNSFTCMMPGTDSRNYQSPGKPGSGVSNP

SEQ ID NO: 789704 - protein, 271 aa, Homo sapiens
MDAGVTESGLNVTLTIRLLMHGKEVGSIIGKKGESVKRIREESGARINISEGNCPERIITLTGPPMPSLRLRYDHRQAGGRYQQLHDQQYRGSRPPVTLRLVVPATQCGSLIGKGGCKIKEIRESTGAQVQVAGDMLANFTERAITIRWRARSLVTEWWFKQICLVMLETLSQSPQGRVMTIPYQPTAGSSPVICAGGKIGGSDAAGYPHATHDLEGPPLDAYSISGQHTISPSIWQAEPVGDNSFTCMMPGTDSRNYQSPGKPGSGVSNP

SEQ ID NO: 789705 - protein, 33 aa, Homo sapiens
MYTQGHSDEQLTTMLPYEGSSRPPWAGVLWATH

SEQ ID NO: 789706 - protein, 117 aa, Homo sapiens
PFSLIGSGNFPTRSNTGLGVLKVKPQSIQHQASCNILPLSVKSIAVSFHYYYQRPYCHLSVKSLNIGGTCVFTAQKNRAGAGTTLWSQAHEPLPSGKALSAHPYFGSLPGGPQVCFQ

SEQ ID NO: 789707 - protein, 281 aa, Homo sapiens
MANSTGLNASEVAGSLGLILAAVVEVGALLGNGALLVVVLRTPGLRDALYLAHLCVVDLLAAASIMPLGLLAAPPPGLGRVRLGPAPCRAARFLSAALLPACTLGVAALGLARYRLIVHPLRPGSRPPPVLVLTAVWAAAGLLGALSLLGPPPAPPPAPARCSVLAGGLGPFRPLWALLAFALPALLLLGAYGGIFVVARRAALRPPRPARGSRLRSDSLDSRLSILPPLRPRLPGGKAALAPALAVGQFAACWLPYGCACLAPAARAAEAEAAVTWVAYS

SEQ ID NO: 789708 - protein, 69 aa, Homo sapiens
MNFKSDSQLYEDTLAGRSVLIKNLTPQTLQPRWTGPYLVIYSTPTAVRLQDPPHWVHRSRIKLCPSEKK

SEQ ID NO: 789709 - protein, 127 aa, Homo sapiens
GSNHCIPPGFAPLRFPASGPRPVPEAPRLTSVSVSPSPCHLHWGLAHSHSGLCRKPCPPPTLFDLPFQSRSPREGRSLLPPVLQLRMVTPETLLRLLPRHPSSRLSRWWRSSPGLRASVPASLPSPY

SEQ ID NO: 789710 - protein, 165 aa, Homo sapiens; identical to SEQ ID NO: 771852

SEQ ID NO: 789711 - protein, 165 aa, Homo sapiens; identical to SEQ ID NO: 771852

SEQ ID NO: 789712 - protein, 67 aa, Homo sapiens
TVPTLLGFKTHKGGPPPAAPSLKSSRPTLQTTRTPKSCAASPAADGHHWEGVEKAHYDGQFRTNPLE

SEQ ID NO: 789713 - protein, 97 aa, Homo sapiens
ENSEPHRRLIKANIWRCQWQMPNYAESDEWTRSYLGLSSNPQLDLPLPRATGFPLSRHHPGLQRAGHFCSSTTSPSHPNQPLPQDLLPHPQGRGGPG

SEQ ID NO: 789714 - protein, 77 aa, Homo sapiens
RSEIQVLPASAVLRVARRGSFALPCPSPHAPDSTVLRSPSHSSAQYSRIPAGSGPHHGQIPHPTFTLRQSIAHIASG

SEQ ID NO: 789715 - protein, 34 aa, Homo sapiens
PKCWDYRREALFPAVGPFSKATSSSAIIQNNTDS

SEQ ID NO: 789716 - protein, 144 aa, Homo sapiens
MKSTVYPLNLIPLADFTSGGHHPLHNTNTWPYPSVPPPRDLKMPGGNYGTQIELGLLVCVTPPHMLGSLEQGRKRRGKRGKVTCRLESVSRPPSARGKPPRPRLCLPGGGWRRGATRSTPGAAGRGAPRAGIRRTRPGSAHRAG

SEQ ID NO: 789717 - protein, 106 aa, Homo sapiens
HQKKCHELSRETCISAVLPPLSLCPQHYIREATREHSHCSSLCRFPNDVCVLSFPGKSLQLPTQTQQCMLESISIDFIMPSIPVDGNHLESPRLYSYPSSTRVIHM

SEQ ID NO: 789718 - protein, 104 aa, Homo sapiens
MGRLSQLGLPQHQTLHGLNNRTLFLTVLEAGKSKLEGAGQSRSRRLGPSLACRGLSSRGVTTRLSLVCARGEISPSLIRSLIQPGVVAHACNPSTLGGQGGRIT

SEQ ID NO: 789719 - protein, 114 aa, Homo sapiens
GDLPESHRGGLGTPPSLALPAAHPHQALYSKSESSTFCVRLCQACYLCWPLGLELRFSAPPRWSAEGWSASAASSPAAPRPRSQARADPGAPGSGGGWKRTLGLSCATRPYRAA

SEQ ID NO: 789720 - protein, 68 aa, Homo sapiens
GSLTLGEFGCHVVRTLSSPMEKCTWGGTEVSCQQPAVSCPPHVSHFGSGAPVEPPDDGSPSRPLYCNA

SEQ ID NO: 789721 - protein, 174 aa, Homo sapiens
RTGRLPGFGGAFVSSCCGSSRSSLYCSVYSAPRGPASVTPLSAGIGRCTAKMPGPPGSLEMGPLTFRDVAIEFSLEEWQCLDTAQRNLYRKVMFENYRNLVFLGIAVSKPHLITCLEQGKEPWNRKRQEMVAKPPESYCVAQADLELLVSSYLTALASLKMWDYRNNPLCQATM

SEQ ID NO: 789722 - protein, 388 aa, Homo sapiens
RTGRLPGFGGAFVSSCCGSSRSSLYCSVYSAPRGPASVTPLSAGIGRCTAKMPGPPGSLEMGPLTFRDVAIEFSLEEWQCLDTAQRNLYRKVMFENYRNLVFLGIAVSKPHLITCLEQGKEPWNRKRQEMVAKPPVIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNL

SEQ ID NO: 789723 - protein, 328 aa, Homo sapiens
MGPLTFRDVAIEFSLEEWQCLDTAQRNLYRKVMFENYRNLVFLGIAVSKPHLITCLEQGKEPWNRKRQEMVAKPPVIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNL

SEQ ID NO: 789724 - protein, 259 aa, Homo sapiens
MVAKPPVIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNL

SEQ ID NO: 789725 - protein, 451 aa, Homo sapiens
RTGRLPGFGGAFVSSCCGSSRSSLYCSVYSAPRGPASVTPLSAGIGRCTAKMPGPPGSLEMGPLTFRDVAIEFSLEEWQCLDTAQRNLYRKVMFENYRNLVFLGIAVSKPHLITCLEQGKEPWNRKRQEMVAKPPGRTGRELWLRELELSHRTASETTVKDKVCRPACVAINGCLPPGLWKGTVSPRLWLGGVWDDYEIIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNL

SEQ ID NO: 789726 - protein, 32 aa, Homo sapiens
MSIRVTQKSYKVSTSGPRAFSSRSYTSGPGSR

SEQ ID NO: 789727 - protein, 127 aa, Homo sapiens
LPGECPSFSHCQQKTLPQPGTEHESGESMMLCDLSFVICCYCALSHPSRLEILTTPSRRPDWILPIQKTFPPSQVQREVVNRATLSKYAHLGSSIFQVLRKQRLRVTPHSQHILLLGQTLWEEPSTA

SEQ ID NO: 789728 - protein, 48 aa, Homo sapiens
RPCCSSALIPYQGKQVLLEDMAQDTLTAASEKKVRDSAGPTDNGCQVI

SEQ ID NO: 789729 - protein, 129 aa, Homo sapiens
MPQPLGAVCQSQAFPLSVLSVPLPQRGHVPPASPFQAWNQFRCSQSHPLMSGLQLGRMTLKRWGARRAQQRLISQGLTAVFIHVNVIPTIRTFLSCCFPLLVPHCFLCYDRVFRTITAAATATPPVRLC

SEQ ID NO: 789730 - protein, 85 aa, Homo sapiens
GLLLNLRSLGICVGCPRAVAGAGSPGLTENEQEEQPDQVRVIGSLLTQPAGVPLCCPRRDPASSPHTAVGLRTPWVQIHICPRQP

SEQ ID NO: 789731 - protein, 85 aa, Homo sapiens; identical to SEQ ID NO: 789730

SEQ ID NO: 789732 - protein, 34 aa, Homo sapiens
MSGARRWLLPAPTTASAGIFRLGGPPALRRTGST

SEQ ID NO: 789733 - protein, 79 aa, Homo sapiens
VYCMVFGAPVFLKKILFRRRSGFAEQQPHCSEDEDADEDPDRKKGRKSILIVPLAKPQSRRARGGAQQAAAPMGCICSL

SEQ ID NO: 789734 - protein, 57 aa, Homo sapiens
MEPCSITQAGVQWCNFGSLQPPPPGFKQFSCLSPISFKDAAYIGRENLEHKVKLPII

SEQ ID NO: 789735 - protein, 126 aa, Homo sapiens
MRIATTLAAEAAALPARHHRLLCLFPSLSPGPCIDLARAAPHCACQLSHALRLSTAGRQGQTSRGKRKQPAQTGTARVLFDQHWNWKLGFEEVKSKYNIVFYNCLLLLHPSQRTLYLKLPVDTNCT

SEQ ID NO: 789736 - protein, 109 aa, Homo sapiens
MKLFRKLLDREGGHKTCFTPVAYNYHKHHFLFSESILTANYMVTLWIEKPKTLEQESFKGVMVVCDCVHSSKSFLVCINQKMKLRPYCWEEQSSLHYLVTTKEKELRFH

SEQ ID NO: 789737 - protein, 225 aa, Homo sapiens
MGPALWAPPHGAWGGRCPWLHGGWWQHRRMAAAATTCRTPHGVQGLPELLSESCTSLRGAQCPVICRGGNGLGATNLLDIRLSLTPQYAPALCPHSLLDPRALWPQSEAQRLWVHGGWAEEAGLMCLTSAPSLCCSFTWSAARTDRNVISVLSGQVVEMFDRQFQELYLTRSSYLTRSCTLTRSCTLTPIAVPQHVCCTSPSKLYLSRSCASPVPVLAGIPLEST

SEQ ID NO: 789738 - protein, 303 aa, Homo sapiens
PTTTKFAASSTTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEWSSTHPRRCVTEGQGDRQPTVVGEEWVDDHSRETVILRLDQGNLHTSVSSAQGQDAAQSEEKRGITARELYSYLRSTKP

SEQ ID NO: 789739 - protein, 438 aa, Homo sapiens
MPQLLQNINGIIEAFRRYARTEGNCTALTRGELKRLLEQEFADVIVKPHDPATVDEVLRLLDEDHTGTVEFKEFLVLVFKVAQACFKTLSESAEGACGSQESGSLHSGASQELGEGQRSGTEVGRAGKGQHYEGSSHRQSQQGSRGQNRPGVQTQGQATGSAWVSSYDRQAESQSQERISPQIQLSGQTEQTQKAGEGKRNQTTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEPDQPGCDRRTCSDTGRDTHHSH

SEQ ID NO: 789740 - protein, 495 aa, Homo sapiens
MPQLLQNINGIIEAFRRYARTEGNCTALTRGELKRLLEQEFADVIVKPHDPATVDEVLRLLDEDHTGTVEFKEFLVLVFKVAQACFKTLSESAEGACGSQESGSLHSGASQELGEGQRSGTEVGRAGKGQHYEGSSHRQSQQGSRGQNRPGVQTQGQATGSAWVSSYDRQAESQSQERISPQIQLSGQTEQTQKAGEGKRNQTTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEWSSTHPRRCVTEGQGDRQPTVVGEEWVDDHSRETVILRLDQGNLHTSVSSAQGQDAAQSEEKRGITARELYSYLRSTKP

SEQ ID NO: 789741 - protein, 295 aa, Homo sapiens
MARTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEWSSTHPRRCVTEGQGDRQPTVVGEEWVDDHSRETVILRLDQGNLHTSVSSAQGQDAAQSEEKRGITARELYSYLRSTKP

SEQ ID NO: 789742 - protein, 348 aa, Homo sapiens
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 789743 - protein, 236 aa, Homo sapiens
VEDEARLCRWASGGHSEPPNKRGLVEGGRLAPGDQLLPWATYLSDDAFGRGRLCRSAVTWGPVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 789744 - protein, 45 aa, Homo sapiens
ERGRSVEAAAGTAQRTGTRPAAWVRFAGRGSPAVQSEEHVAISNH

SEQ ID NO: 789745 - protein, 105 aa, Homo sapiens
MRRDHATALQPGPQREAPSQKKKKEREKERKKKKERKRKKKKEREKEKGRKKEREKEERRERKKERKKERKKERKKEREKRRNKGKERKENLMPRSMVHGKIVFH

SEQ ID NO: 789746 - protein, 109 aa, Homo sapiens
RGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 789747 - protein, 109 aa, Homo sapiens; identical to SEQ ID NO: 789746

SEQ ID NO: 789748 - protein, 73 aa, Homo sapiens
IVNLEEGGDCYRCLSTPLLEKAMSLNMVLLIVTVRNLKKQEVETKRGKSQWKLTFALILIAPVRQACYVSGKW

SEQ ID NO: 789749 - protein, 120 aa, Homo sapiens
MDSSSSGVSDWRDASGRGSFPGAPAFVMVDAPLRCHLLRRTSCSVLDRWAPVGPPRLEMNLKGTPCLGDLSQAGQRNNQTTVSAWRLQSFAQGPSEGGLGKTSWGLGQLSKMDKESNHLC

SEQ ID NO: 789750 - protein, 118 aa, Homo sapiens
LVAPACNPSTLGGRGRQIMRSGDQDQPGQHGETPSLLKYTKKVRYGGAPVFPGTHKRLRQEDPLKPGGKRCSELRSCHCTPASAIEQDPVSKKQKTCKKHSYCACDEREFGGEIICLL

SEQ ID NO: 789751 - protein, 75 aa, Homo sapiens
PGGRMDPLTSTKDGLHHSGPSMAENHSLKTYTLKTIRYYAYSLVLINLEELKIFPNRSLHKGSCYLKPHYNNYYY

SEQ ID NO: 789752 - protein, 108 aa, Homo sapiens
IKAPSFPDTFRVESRHRIYSLWYSVRSREPPTEENAYVSLSPWTNTRMYSPMRSTSQKELADRLGKSSHCPHNVCGPWRGCPGELDCFQCLCLGGASSIGAFLVSEVC

SEQ ID NO: 789753 - protein, 82 aa, Homo sapiens
RHTYAGVHTSTYAHMRTHTCTDMHTCMQLCTCVQAYTHTCTHTHACIHMHTHTCTGIHMHTHVPTRPAWPPRLQATLIPATS

SEQ ID NO: 789754 - protein, 108 aa, Homo sapiens
PHIGPSCFQLLQRAFAAKASSSPLLRPSMATPTQTPTKAPEEPDPFYYDYNTVQTVGMTLATILFLLGILIVISKKVKCRKADSRSESPTCKSCKSELPSSAPGGGGV

SEQ ID NO: 789755 - protein, 145 aa, Homo sapiens
PHIGPSCFQLLQRAFAAKASSSPLLRPSMATPTQTPTKAPEEPDPFYYDYNTVQTVGMTLATILFLLGILIVISKCDPFLGCLSLRFLCWLSSISYPLCPVFLFCLSLPTGKKVKCRKADSRSESPTCKSCKSELPSSAPGGGGV

SEQ ID NO: 789756 - protein, 66 aa, Homo sapiens
DAVAQSTRIIYGGSVTGATCKELASQPGVDGFLVGGASLKPEFVDIINAKTMSPIHLPYPSCQARD

SEQ ID NO: 789757 - protein, 112 aa, Homo sapiens [sequence omitted]

SEQ ID NO: 789758 - protein, 71 aa, Homo sapiens
GSSPWLHTPCLLHDPVGQVAALQGRESGDKDPEFHSPVTISKLLSMAGPPFSRWYWEGLHQDMIRGPFLLQ

SEQ ID NO: 789759 - protein, 67 aa, Homo sapiens
SQRARKENWHNMEERHARSSDFRQFILKLAQSSSFQDNKQRLFQEKFKMATQRADERQHRRKSSEKL

SEQ ID NO: 789760 - protein, 105 aa, Homo sapiens
SEGSRRSRRQGSSVSQDSDSEGHSEDSERWSGSASRNHHGSAQEQLRDGSRHPRSHQEDRAGHGHSADSSRQSGTRHTQTSSGGQAASSHEQARSSAGERHGSHH

SEQ ID NO: 789761 - protein, 96 aa, Homo sapiens
EWNAMVRSRMEWNEMEWNGMEWNGIGWNEPVSIGMEWNGMEWYGMEWVQLEWNGKEWNQHRVEWHGMEWNGMEWNGMEWNGMEWNGMEWHRMEWNQ

SEQ ID NO: 789762 - protein, 73 aa, Homo sapiens
QGDSGGPLVCDKDGLWYQVGIVSWGMDCGQPNRPGVYTNISVYFHWIRRVMSHSTPRPNPSQLLLLLALLWAP

SEQ ID NO: 789763 - protein, 144 aa, Homo sapiens
EKQSTTPGKTKARQEKQSHGPAWFSSEQGVYHHHVNSRGRSNPRESHSDGYEWGAQVCSGEGRPYRVTCSPWSPGKVSSPKPIPKWPLGLALRRARQRLWEVGGITPEVTHALIGSVCVPTQISSSIVVPISPTCRGRNPVGRN

SEQ ID NO: 789764 - protein, 109 aa, Homo sapiens
NIRVLPETLESGVVRLESRLQSVEEWTGDQEILEFSSETNWGSTIQFNSDPKEEESAPDVVATVRTVLENDPIGQCKRDCREEETTAEKPDEEIKLNINYLKNIPRSDC

SEQ ID NO: 789765 - protein, 473 aa, Homo sapiens
MAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASPLPRYSYLSPLLY

SEQ ID NO: 789766 - protein, 229 aa, Homo sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGEDEEETNVIVLSYPQYCRYRSMLKRIQDKPSSILTDQFALALGGHCSGQQEPSDPVLSGHL

SEQ ID NO: 789767 - protein, 639 aa, Homo sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASPLPRYSYLSPLLY

SEQ ID NO: 789768 - protein, 224 aa, Homo sapiens
MKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASPLPRYSYLSPLLY

SEQ ID NO: 789769 - protein, 145 aa, Homo sapiens
SPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPY

SEQ ID NO: 789770 - protein, 172 aa, Homo sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGKYDL

SEQ ID NO: 789771 - protein, 719 aa, Homo sapiens
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGEDEEETNVIVLSYPQYCRYRSMLKRIQDKPSSILTDQFALALGGHCSGQQEPQILYCRDTFDHPTLIENESICDEFAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASPLPRYSYLSPLLLLII

SEQ ID NO: 789772 - protein, 229 aa, Homo sapiens; identical to SEQ ID NO: 789766

SEQ ID NO: 789773 - protein, 386 aa, Homo sapiens
LGFQNRLFSSDCCICIEAWHYESLYDVRLNFPLPFFQITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASPLPRYSYLSPLLY

SEQ ID NO: 789774 - protein, 97 aa, Homo sapiens
FNPATRSRIVYFILSRVKYQVINNVSKFGINRLVNSGIYKAAFPLHDCKFRRQSEDPSCPNERYLLYREWAHPRSIYKKQPLDLIRKYYGEKIGIYL

SEQ ID NO: 789775 - protein, 104 aa, Homo sapiens
MDGVLGGHTYCTLLQLTRMYPGLQVYTFTERMMAYCDQIFQDETGKNRWREAEDENHLNPAGGGCSELRSHYCTPAWVTKLDSLSLKQTNKKKHFLGGRGGSCL

SEQ ID NO: 789776 - protein, 148 aa, Homo sapiens
MVQKYQSPVRVYKYPFKLIMAAYERRFPTCPLIPTFMGSDTVNEFKSEDGAVHVIERRCKLDVDAPRLLKKIAGVDYVYFVQKNSLNSRERTLHIEGHNETFSNCYTVHPENEDWTRFEQSASLDIKSFFGFESTMEKIAMKQYTSNI

SEQ ID NO: 789777 - protein, 87 aa, Homo sapiens
DSHICNCLAIACSWLLCVGLACMTGTTGVPLLPGLIHEILPYLQYQDLSSLAQYSNCAMHLYMWITSGPLHLPVPKKESQENGDPPR

SEQ ID NO: 789778 - protein, 395 aa, Homo sapiens
MAAPDGRVVSRPQRLGQGSGQGPKGSGACLHPLDSLEQKETQEQTSGQLVMLRKAQEFFQTCDAEGKGFIARKDMQRLHKELPLSLEELEDVFDALDADGNGYLTPQEFTTGFSHFFFSQNNPSQEDAGEQVAQRHEEKVYLSRGDEDLGDMGEDEEAQFRMLMDRLGAQKVLEDESDVKQLWLQLKKEEPHLLSNFEDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRCVGGHWPVLRAPPRSLGSEGPV

SEQ ID NO: 789779 - protein, 130 aa, Homo sapiens
ARGSGGAGGCLTAESRAGGAGRSTGSLHAQGHALTTAALQEAGTEPPGAIGLFVKGGAAATCHSSSMSPARASTGHLAQEKPCRSRIQSAGIQQECQENSTQVCCLLSCQVCGCTGVLLMVLFWMPGIQL

SEQ ID NO: 789780 - protein, 109 aa, Homo sapiens
SNPNSKDIQNEAKETGKLLSSQWSCHKVHALKCFTFIKVNNKRKIIRAYSLIFTFSLETNVYRSKISKVKVNFKCAKFYQIVFLVSSISLFPARLIRIEIEDICWQQQK

SEQ ID NO: 789781 - protein, 66 aa, Homo sapiens
EKEIKGIRIGKEEVKLLLFADDMIIYLENPKDSKKRLLDLIKEFSKVSGYKISVHKSVALLYTNND

SEQ ID NO: 789782 - protein, 96 aa, Homo sapiens
EAEASAPVKPSDDGSPSQRHDAASGETLSQGHPPELTLDPDPQKLQVDKAAHREQRFSLPSFSEDTTGAQRGEETSPACTAESFPKWMRPQHRRNA

SEQ ID NO: 789783 - protein, 117 aa, Homo sapiens [sequence omitted]

SEQ ID NO: 789784 - protein, 132 aa, Homo sapiens
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKS

SEQ ID NO: 789785 - protein, 121 aa, Homo sapiens
MLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKS

SEQ ID NO: 789786 - protein, 55 aa, Homo sapiens
FPFCCRVDDMPPGISLLPDNILQVLRIQLLQCVQKMADGLEEQQQALSILLVKFF

SEQ ID NO: 789787 - protein, 843 aa, Homo sapiens
LRGRKRFVCPASRRPAAGLRDAASSAPRGMASEGPREPESEGIKLSADVKPFVPRFAGLNVAWLESSEACVFPSSAATYYPFVQEPPVTENVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 789788 - protein, 883 aa, Homo sapiens
LRGRKRFVCPASRRPAAGLRDAASSAPRGMASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 789789 - protein, 320 aa, Homo sapiens
LRGRKRFVCPASRRPAAGLRDAASSAPRGMASEGPREPESEGIKLSADVKPFVPRFAGLNVAWLESSEACVFPSSAATYYPFVQEPPVTENVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRDPKNVSIPSSEALSSDPSYNKEKHIIHPTQKSKASQGK

SEQ ID NO: 789790 - protein, 800 aa, Homo sapiens
LRGRKRFVCPASRRPAAGLRDAASSAPRGMASEGPREPESEGIKLSADVKPFVPRFAGLNVAWLESSEACVFPSSAATYYPFVQEPPVTEKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 789791 - protein, 81 aa, Homo sapiens
MEQPVIVAGTPVPHAHHQPREFYCYKLVLLGTFPHPEPAGSSSFRGARVAACPFRPWAASAQLDACSGSHLLPPLLSRMCS

SEQ ID NO: 789792 - protein, 90 aa, Homo sapiens
KMNAGKKGLISSKNAAGRRQDTAHELENTWSEGSPPHSGISNSNEKQPQYRGAGKTTPQSKAAGSLPRGFGEKVCCMEEFIKGSRREFWK

SEQ ID NO: 789793 - protein, 115 aa, Homo sapiens
FERPPGQVRGEWSGMEGNGMESSGIEWNGMEWNGINSIEMEWNGMEWNGVDGNGMMECNEPECRGMEWNGMQWNGVILNGTEWNGMESTRVQYNGIERNGMEWNGFNPNGMKRNG

SEQ ID NO: 789794 - protein, 184 aa, Homo sapiens [sequence omitted]

SEQ ID NO: 789795 - protein, 125 aa, Homo sapiens
RSSISHLKKAASEEKPLGVGEMEEECTLEPELAAFPKQDGGTQEYTDATLEDHRGDVQEADTLHRQLSLSQCFPLLMTEEQQNPGEQISTNIHASGEEKCYEEVQVQNEASFSTLEGEMIETSFS

SEQ ID NO: 789796 - protein, 311 aa, Homo sapiens
MEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFASVLSSLQRPNGAKAALVKSSMF

SEQ ID NO: 789797 - protein, 368 aa, Homo sapiens
ALTNNVLGAVLGCNFHHLAWRLCCIIPMSMGPSQFNHPSFISFFHLAEPSRTFSMYKMEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFASVLSSLQRPNGAKAALVKSSMF

SEQ ID NO: 789798 - protein, 109 aa, Homo sapiens
MPRPLLVPWWTLIQLGLMLSSFTCMHHSICLELEPLASEFREDACGPITVTSTLWPLWIQSRVPLLLCVFLYLPNFLQLSCVTFAISKCKPQNRQDESTYSKCRPKPCT

SEQ ID NO: 789799 - protein, 420 aa, Homo sapiens
LIMEAQRRNQLPGDPENCWSLARGKSGSVFVGDGTEPGFGAQPGSGGDRVCPGGRPRLLMAVKRRSGGFKSHSATERVERSRLARACYAEATPPETHPQPSALGQEARKATEAAERGRGAPLSPSCGGSGCPCSASRSPPGVPALRSAAELGTEAAGSRPFRPLSRSSSAACRGPRAGETGQTPEAAGGCSFDGPNTPALPFRLLKIKSLGPGATIAQPRSSTTGRRPVLQAFFTEWLRRLRPRFPAPPRRSCAHLLKSLASSGIRTKTTADITPFQRRKRKCPESQGATSGATGGGGEALPGLPTRQEAAAPGPRLPSPRATSRETPRISPGNPGQRRRPSKDRQQAETGRLGREQRDTEPPGARWERGEALGSGKLRSEWPWRTVKEPGPRGGREWTRLVRAGRRGRGGSALPELYLL

SEQ ID NO: 789800 - protein, 79 aa, Homo sapiens
AVTLHLAVTLHLAVTCPLSEAQPPPGGTQDIRSCSESPDGGWARWLTSVIPALWEAEAGGSRGQEIETIPAKTVKPRLY

SEQ ID NO: 789801 - protein, 313 aa, Homo sapiens
MQGDLKTTDLRIQAPSADLEVQAGQVDLKLPEGHMPEVAGLKGHLPKVEMPSFKMPKVDLKGPQVDVKGPKLDLKGPKAEVMAPDVEVSLPSVETDVQAPGSMLDGARLEGDLSLAHEDVAGKDSKFQGPKLSTSGFEWSSKKVSMSSSEIEGNVTFHEKTSAFPIVESVVHEGDLHDPSRDGNLGLAVGEVGMDSKFKKLHFKVPKVSFSSTKTPKDSLVPGAKSSIGLSTIPLSSSECSSFELQQVSACSEPSMQMPKVGFAGFPSSRLDLTGPHFESSILSPCEDVTLTKYQVTVPRAALAPELALEIPS

SEQ ID NO: 789802 - protein, 476 aa, Homo sapiens [sequence omitted]

SEQ ID NO: 789803 - protein, 140 aa, Homo sapiens [sequence omitted]

SEQ ID NO: 789804 - protein, 122 aa, Homo sapiens [sequence omitted]

SEQ ID NO: 789805 - protein, 140 aa, Homo sapiens [sequence omitted]

SEQ ID NO: 789806 - protein, 205 aa, Homo sapiens [sequence omitted]

SEQ ID NO: 789807 - protein, 135 aa, Homo sapiens
MRAWMFVSMQAEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNS

SEQ ID NO: 789808 - protein, 221 aa, Homo sapiens
MWTGYKILIFSYLTTEIWMEKQYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRPELIEQVNKGDYGWTAQNYSQFWGMTLEDGFKFRLGTLPPSPMLLSMNEMTVSVPSDSRMCMYL

SEQ ID NO: 789809 - protein, 155 aa, Homo sapiens
MASRSDGRGKRHATKPCPNNVEKSNRIYQCSPPYRVSSNETEIMKEIMQNGPVQAIMQVREDFFHYKTGIYRHVTSTNKESEKYRKLQTHAVKLTGWGTLRGAQGQKEKFWIAANSWGKSWGENGYFRILRGVNESDIEKLIIAAWGQLTSSDEP

SEQ ID NO: 789810 - protein, 140 aa, Homo sapiens [sequence omitted]

SEQ ID NO: 789811 - protein, 140 aa, Homo sapiens [sequence omitted]

SEQ ID NO: 789812 - protein, 142 aa, Homo sapiens
MRAWMFVSMQAEIWMEKQYLSQREVDLEAYFTRNHTVLQGCFKDGQHYEEGSVIKENCNSCTCSGQQWKCSQHVCLVRPELIEQVNKGDYGWTAQNYSQFWGMTLEDGFKFRLGTLPPSPMLLSMNEMTVSVPSDSRMCMYL

SEQ ID NO: 789813 - protein, 107 aa, Homo sapiens
RWIYEFSPLRNQTGPPRVGLLPPNALDLPWAQAGAQGIPLCSTTQQLLFKRRKTLLHAIHSHRTILYPFVRDNKTDGKSLWNLLWPWVKGRLTGAGRRKLKLTSLGF

SEQ ID NO: 789814 - protein, 154 aa, Homo sapiens
DRVMLIGTTSRPQLAEMRGLCRVYERILFMPRPDYASRYVLWKRMIEARGIQPTQHLDISALAKVSDGYTPGHILQAIQSVLSERRFLQLSKRPLVASEFLGQLVKLDPVYREEEESLKDWYFKTPLGKKSMKHRMDQLEAEEAKLDKEKKKRK

SEQ ID NO: 789815 - protein, 129 aa, Homo sapiens [sequence omitted]

SEQ ID NO: 789816 - protein, 366 aa, Homo sapiens
GNASDVVLRVQAAGTDEVRVFHAHRLLLGLHSELFLELLSNQSEAVLQEPQDCAAVFDKFIRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLV

SEQ ID NO: 789817 - protein, 160 aa, Homo sapiens
KGKHWEASGWGFHCVCTRTMKLQLDGRSPVDSNVDSKKSILGGGYRPDPAPPLGLSRRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLV

SEQ ID NO: 789818 - protein, 317 aa, Homo sapiens
IKMPRRGYSKPGSWGSFWAMLTLVGLVTLQHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLV

SEQ ID NO: 789819 - protein, 39 aa, Homo sapiens
MEILHEEMDTVAGCPAGVLCREAGSIWMNELTVLCVALQ

SEQ ID NO: 789820 - protein, 112 aa, Homo sapiens
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDP

SEQ ID NO: 789821 - protein, 82 aa, Homo sapiens
MNLSVHETSCTAPGSWEKQVPFSDVRGRRLPHLARCRAPPGHPSPSAPLPPPPVPGRRQSRLAGNYCQRSPPGSGGGRAGGG

SEQ ID NO: 789822 - protein, 131 aa, Homo sapiens
LGKEGAYQATSTGAERSQRARVPQHSSGVEAACVWWRGRLRGGCSPVGPGPGFGRCSTAKRGARKRPSLRSSRYRSREKAGIRSNTSSPSGSACWAGGGDGGGCGGGGGCHEAGAPGDKAAAPLDPRGSSC

SEQ ID NO: 789823 - protein, 1005 aa, Homo sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 789824 - protein, 123 aa, Homo sapiens
DIGACLAILSLRIYYKKCPAMVRNLAAFSEAVTGADSSSLVEVRGQCVRHSEERDTPKMYCSAEGEWLVPIGKCVCSAGYEERRDACVGERAMAWAWVSRQRCLVLAGLPGCKGGRQSPQAPE

SEQ ID NO: 789825 - protein, 340 aa, Homo sapiens
PRFCRWLRRCRSKSVGAREALAAEAAAQGPSHQVHVLVSHEAQEVLETLPARGTAEALGAGTGTPASTCHRRPACVLTPRHPCQCRHGRPHLPRQPVVQHAGRIRAAGAVRGLQAAGCGREQALGGGLVDQLVPHEVLDEAEGLAAGVAAVWLLCHVDLLVTHDVKEIREVLAAVRAGVAQPIGGPCRRARGPGPTGPRCALGGGEAGCPGQGAGQLEPVHLAVAGEALRVAEDLAAELALVGPLARVHHVMLAQVEGFAEALPTHGALVGLLARVDALMALQGLAAPEAAPADAAAERLSWDAGARASRPAGPRAAEQQRVGAQERDGHSAVHHRRRGR

SEQ ID NO: 789826 - protein, 35 aa, Homo sapiens
VECSPQSVRTAPPVPMPSACGIVVLQCGQALTFGD

SEQ ID NO: 789827 - protein, 218 aa, Homo sapiens
GLLIFRDVAIEFSPEEWSYLDPAQQNLYRDVMLENYRNLVSLGIAVSKPDLITCLEQRNEPWNVKKHETVARHPAVSSHFTQDLLPEHGIKDSFQKVILRRYGSYGIENLQLKKDWESVGESKVQKECCNGLNQSLSTTHTKIFQFNKCVKVFSKSSNLNRHKIRHTGEISSNCKECDNSFYISSVLTPLQRIHTAEKSYKCKQCGKAFRHCSCFLEH

SEQ ID NO: 789828 - protein, 112 aa, Homo sapiens
MSSHCHASAMLSPMSPLQPQRCSVVCCQCFQQGVFQLFPLLHCFLMTKFILLPSQQSLICDSVMCAFGCECVCVCIHLREKTDFIISLNKLAHYICYPLSNKNRNCVIWTKW

SEQ ID NO: 789829 - protein, 110 aa, Homo sapiens
VRTGSCGVPAAVTPAAGPRRPPRLPLPLRAGRAPGRRSVLGAPRCCLCLGFSRPLGLFVSAVLRLSSVSLGPSLPRRALAGRLVARGGGGLGAGRDERRLHELRERRAGG

SEQ ID NO: 789830 - protein, 78 aa, Homo sapiens
YSLSLFHSSGKVPGEDVERSPVGSRARIRLKTVIQVRLLTLGQLSAIWTAKPRGQIPLRGQLLHLCKAGFHLLSGPGT

SEQ ID NO: 789831 - protein, 154 aa, Homo sapiens
LQSQVLACPCCPPDHLVLPATLPAPLSPRDSLAASTCWPLPAHPLSKPALPLSSWGGEGRPRLLPAATPTCHGAPLQHHQALPFPKQRDGTAVQISGPAPREGPRCRSQAAHLGVRGTSAPFSTRWCLSVGRERFYPSRTLFSVVLPSFKKCRI

SEQ ID NO: 789832 - protein, 76 aa, Homo sapiens
KAVNWKHRLQAAGAALSRSSGKSSLTWGPCCEQRHQPGNLFSVGDTGYPPGKPEKRPFRSDLRPSHRRVLHTPRDG

SEQ ID NO: 789833 - protein, 179 aa, Homo sapiens
PRPHTWDSRACSSLLDSQTATQTALLETRELHDHEDEWVPVGLQDMASTCRGPVQSAGVDSDSWLHPVFRSQPAPSLPRTQPFFSGTCHTARSCHSPSPEMTTLSSQSTGWGPVLCGCLSCITTICLHLEHLTRMYSPHTVKPHTKLTQITMCMVKPTQGTSDCQEIRNKIRRATEKWL

SEQ ID NO: 789834 - protein, 139 aa, Homo sapiens
TQKLPYCPGWDASSEAVTNLERLAHSRRCRAGNQGRQGSLETDTPPFFLFQYHQVVDISPKLGQLNLPSWDLNPWRSLDTQIKCSLDTSLAPGTVPWPVSHHTPSGGSSTPRSEPGCHPFPSLVPQPSHQFWAHLAPFQ

SEQ ID NO: 789835 - protein, 199 aa, Homo sapiens
MQKWSLEYIQEIAGCRTVPVEVGSRYTDEEWSQTLMTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVSFWWS

SEQ ID NO: 789836 - protein, 416 aa, Homo sapiens
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKKARADHGLIPDVKLEKTVPRLHRPSLQHFREQFLVPGRPVILKGVADHWPCMQKWSLEYIQEIAGCRTVPVEVGSRYTDEEWSQTLMTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVSFWWS

SEQ ID NO: 789837 - protein, 58 aa, Homo sapiens
LPVQKPDKSYRLVQDLRLINQIVLPIHPVVPNPYTLLSSIRSSTTHYSVLHLKDAFFT

SEQ ID NO: 789838 - protein, 104 aa, Homo sapiens
PAPRAPRLGRCGLHRAALRVAARGEKKEGGGGGDVAASLGGAGAAASQTLQQCGQLQKLVGSSRSLSASPLAACAGCQQVRCVQGPHPAGDTDPGGKGVVDPGW

SEQ ID NO: 789839 - protein, 55 aa, Homo sapiens
MWLSERAASGSWFACLPFTLQPSYLLRPMLVQLNPMHILQALIMTFQQYLPSAAE

SEQ ID NO: 789840 - protein, 79 aa, Homo sapiens
YKCQCKKPIQAATWDRRALGIREVAQDNSSDHCVAATVERSAPEPVFLLWSQSLSLPFQHQLPLDHVEKRDKLSLQTSG

SEQ ID NO: 789841 - protein, 106 aa, Homo sapiens
CCSRLRVGPGSGAREKESLANQHSVLVDRPSPEAQAHLRQQRASARQQKQEESRPEDTYPGRKTCTPEDRERPSGCCVAVPSDWNTSCLQDTVKPLLSTHLVLTPF

SEQ ID NO: 789842 - protein, 111 aa, Homo sapiens
LGRLVTLIVSVLTVGFHLAGSQNRNPDALTGNVNVLAAKIAVLSSSCTIQAYVTWNLITLWLQRWVEDSNIQASCMKKKRSRSSKKRTENGVGVETSNRVDCPPKRKEKSS

SEQ ID NO: 789843 - protein, 96 aa, Homo sapiens
LTRTMGNMKVTGALPLRSTQPGILMAFRWLDHSLPTVDTTELEAASTFVLFCLLQHLALLPGLEYSGIIMADCNLDLLGLSNPAVPAPGESGRRMA

SEQ ID NO: 789844 - protein, 142 aa, Homo sapiens
CRLSDQDEEGKIKQEYIISDPSFSMVTVQREDSGITWETNSSRSSTPWASEESQTSGVCSREGSTVNSPPGNVSFIVDEVKKVRKRTHKSKHGSPSLRRKGNRKRNSFESQDVPTNKKGSPLTSASQVLTTEKEKSYTGIYD

SEQ ID NO: 789845 - protein, 244 aa, Homo sapiens
RGHGARGGKAKDKEEIPITKLGLLVKDMKIKSLEEIYLFSLPIRESEIIDFFLGASLKHKVLKIMPVQKQTRASQGTRFEAFVAIEDYNGHVGLGVKCSKEVATAICRAINILAKLSIVPVRRGYWGNKIGKPYAVPCKVTGHCGSVLVRLVAPPGDTGIVLARVPKKLLMMTGIDDCYTSARGCTATLGNFTKATFDAISKTYNYLTPDLWKETVFTKSPYREFTDHLVKTHTRVSVQRTRAP

SEQ ID NO: 789846 - protein, 91 aa, Homo sapiens
MYSHVYTGTASPQPSSPAPPRGGLDPPSSPAWRQTQGPLQDTTQHQPRNSSKAPGPLSGLGLGATREGPRGPPGRAPWVRARAGGAVPGPA

SEQ ID NO: 789847 - protein, 81 aa, Homo sapiens
TRWKSPRPSLQGDVALSVSQGSVGNGQGTFIWSHWGAGPQRMHRLEVGKGKTLLVKAGACAKTRKQDCFWELWDLTQKFRG

SEQ ID NO: 789848 - protein, 102 aa, Homo sapiens
MREQSAWLPPATPRARREEETVGAARRGPAAAAAAASQRGLCSWAPERFPQPRPPLLTPLQQSAGGAATEGAGSRSRELAPSAQSRSRRRAGGRAAAGGDGR

SEQ ID NO: 789849 - protein, 118 aa, Homo sapiens
RWLLLHGLHLALGLLAVSDHPYPRRTLDPQPGPPCLPSWMSPGPRAVLCLEGILSEGTSPVALPGTSFRATMALACFSPSLHAGSATACPGPMDVGTSRSAVAERPLALGGEAITVSY

SEQ ID NO: 789850 - protein, 46 aa, Homo sapiens
MVLAAPNSGASESPCLSRRRLHERVQKNKGTGSPMGLLIAIYQHDY

SEQ ID NO: 789851 - protein, 331 aa, Homo sapiens
MSKTFVKSKEMGELVNTPSWMDKGLGSQNEVKEEESRPGTYGMLSSLTEEHDSIEEEEEEEEDGEKPKRRGPKKKKMTKARLERFRARRVKANARERTRMHGLNDALDNLRRVMPCYSKTQKLSKIETLRLARNYIWALSEVLETGQTPEGKGFVEMLCKGLSQPTSNLVAGCLQLGPQSVLLEKHEDKSPICDSAISVHNFNYQSPGLPSPPYGHMETHLLHLKPQVFKSLGESSFGSHLPDCSTPPYEGPLTPPLSISGNFSLKQDGSPDLEKSYSFMPHYPSSSLSSGHVHSTPFQAGTPRYDVPIDMSYDSYPHHGIGTQLNTVFTE

SEQ ID NO: 789852 - protein, 180 aa, Homo sapiens
ASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSCPAPPPALHFCRPHPSTLAT

SEQ ID NO: 789853 - protein, 93 aa, Homo sapiens
SYLKSVCEMAGKGVKTITSVAMTSVLLPIIQKLELQIAVANIRVCKGLDRIEERLPILNQPSTQVVANAKGAVTGAKDAVTTTVTGAKDSSQG

SEQ ID NO: 789854 - protein, 150 aa, Homo sapiens
SWTLCCVSLCILVAKHTDAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSLATALQNHPFPVQKPWCFSFSFYLPAVLGKVFPVPPSP

SEQ ID NO: 789855 - protein, 110 aa, Homo sapiens
RGISGVSLPCTPQFPSGNSRMRCRDPSSTRCSSSLCQELGLSHRPSNLPFRPFPTGTDESSIRRDPSIWDFGIVGRSFTVCRGMQLSQCLLLRNSLCALPSLTPDPRPLS

SEQ ID NO: 789856 - protein, 245 aa, Homo sapiens
RSGDVMQAKMAEGEDVGWWRSWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTTVLAQLSPMMAPRARLYSLQSDPATYCNEPDGPPELFDAWLSQFCLEEKKGEISELLVGSPSIRALYTKMVPAAVSHSEFWHRYFYKVHQLEQEQALEGRPEAAGCSGDSCT

SEQ ID NO: 789857 - protein, 55 aa, Homo sapiens
CNFMFPGLDFLFNLTYLEYIDFSVCEDSCFYWISKIVTYVFKLCLFTLLSSSPIL

SEQ ID NO: 789858 - protein, 53 aa, Homo sapiens
MLNAKATTGAGQGVWAKWSSLCWEPVVSLQVMCQGQVGAEEMSLAQCCPGTGA

SEQ ID NO: 789859 - protein, 184 aa, Homo sapiens
MVRYSLDPENPTKSCKSRGSNLRVHFKNTRETAQAIKGMYIQKGTKYLKDVTLQKQCIPFRHYNGGVGRCAQAKQWGWTQGRWPKKSAEFLLHMLKNTESNAELKGLDVDSLVIEHIQVNKAPKMRRRTYRAHGRINPYMSSPCHIEMIFTEKEQIVPKPEEEVAQKKKISQKKLKKQKLMARE

SEQ ID NO: 789860 - protein, 103 aa, Homo sapiens
PQTNTLNKCLWIGRTRHGLQRQTDKVLRGKSGSISNQTVLVSWVWRRLSTTLWSSLRLTQWFKAEVEVIGTKLMLQERDEGGRMDSSALPWVSEMKIFRISAN

SEQ ID NO: 789861 - protein, 72 aa, Homo sapiens
IMINQEMEYGDHVSDGVITFFCRIEAVRGDMSHQAERSHPEIPIPRAYHLEFLLHVHINVNKGRVFSIITYK

SEQ ID NO: 789862 - protein, 83 aa, Homo sapiens
MMHTLCGHCGSKACHLPKSTCGKCGYPAKRKRKYDWCAKAKRLKATGTGRMSGVDFHKGTTPKPKRAAVAASSSSQEFICFFF

SEQ ID NO: 789863 - protein, 206 aa, Homo sapiens
AEVTASQEARGLRLSDLEDLEEEEEEEEEAEDEEVVATAGDRLTEFRKGAQSLPGPCAAAREGRLERRECGLAAPRFSFNDPSGSEEADFLSAETGSPRLTMHYPCLEKPRIWSLAHTATASAVEGAPPARLGHEVLSAVMIPGQPPASARRLSVPRDSACDESSCIPKAFGNPKFALQGLPLNCAPCPRRSEPVVQCQYPSGAEG

SEQ ID NO: 789864 - protein, 77 aa, Homo sapiens
VVLEIDTTTPPFAQRLHPGAILDWSLSSFPTSNPPVTLDAGSTSISTTLVQATNLSQLGYCNGLLPRPQRWPCSLTF

SEQ ID NO: 789865 - protein, 98 aa, Homo sapiens
PSHSPIAPIPIPPLEGPAGGGCGPHALCVPVSWSLSPESGSRQVRGEGSVRPAEGRVPAREREPGTRRAGRKLPHKRPESRTWIELKLRRRPAVTPAA

SEQ ID NO: 789866 - protein, 127 aa, Homo sapiens
QKAPGGQASRCLYQWLDIGRGTLWTPEGTGRKQGERAVDGDQGPWILVSALPQAGCVASPLWALTQKADIRVRSPLGPCGASSLRSFWIIRDHREKLLPSERLIGWAAAPRNIFREPCSLAPWHPRN

SEQ ID NO: 789867 - protein, 115 aa, Homo sapiens
SSQKYRLLSATTGWRNISERYVSGTPKGILFLSPWHRPCSTEERPGLQWSLQQSSSLWNSGSHRVTGEETKLTWEESLSFSFSPTETLYIGPTVHHKTHMLSFFLSHPHLGNPKT

SEQ ID NO: 789868 - protein, 148 aa, Homo sapiens
AAASAPPPCAPPDSLGEKRPQRDMLGRGSLHPPIPPFMTYCSIIFLGWLLGKPQDITIHRQKRPIDDCPLESSKRVWEASPETRDTKGLEDTSEDRSKVTLFTGEKAEAWRGSTLCPRSQVGYSRAGEESRLPGKENKGFIDPSPSRA

SEQ ID NO: 789869 - protein, 197 aa, Homo sapiens
MLPLVHLHLSCCRVYSCLQSAPSRPLPLSRTPHAPARAPAPRWPATRPHHHLRRPPPPPLPRPPTPPSLLLAPPHTTSPLPPHRRPGPYHHPPHHTSHPTPTPTPPAPLHTRPTPALRPPTTHTHTTPTRTTHNTHPHPPTTTPPPLTKHTTHTPAPTPPHSPHPTHTPHPPTHTPPTPPPPSPHHTLHPPHHHTPP

SEQ ID NO: 789870 - protein, 339 aa, Homo sapiens
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPCEPWGSQASPTKSERGLREPQELQTLTSGTPFGDVLPQDPVRDALAPNPEGGGRGSHVRWSSQTGRLLGQRGNGAGGQTMGGAGARSGESTTRQVWATSMGGHKPRGEHIEPMIRPQCTQEAGHHNAGGQHLAVVTHIIALADRRVSPKNERKRREQKRRGHNN

SEQ ID NO: 789871 - protein, 353 aa, Homo sapiens
GGEAGSARSSSVPPAPRSGSSTLAPAMPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGI

SEQ ID NO: 789872 - protein, 296 aa, Homo sapiens
AGGRLSAEQLSAPRAPLRQLHARARHAGAVQRRRVPGRHRGGPQLPGWGRRLRRQDAPILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREVSP

SEQ ID NO: 789873 - protein, 125 aa, Homo sapiens
TGGACFLFSSPKPSKDSSFQPRVGTRNKGPPEEGWRLSREHGQGVCSPFSLPERGPGWREIHHTAHPGSASPSRGSRSGSARLPIRRHPEDGHRARGCASKPSPSPSLSGVSASVSFFKSCVTCM

SEQ ID NO: 789874 - protein, 160 aa, Homo sapiens [sequence omitted]

SEQ ID NO: 789875 - protein, 75 aa, Homo sapiens
SDVNQAPVRGNLTTQWKCEHGNQAASPLAATQGRGRGHSRKALWPQTPHKATWLGTCPSRGKSRHQGGLQLDDSS

SEQ ID NO: 789876 - protein, 101 aa, Homo sapiens
AAPAPGQAEPFRDESAPWGRCAKSSGEAPPLLGVSAARTALPPKTPGRPLPAWRGQRAPLAGRGRGRGARAGAAPEPTVHALPAALTFSLMELVDFTEYME

SEQ ID NO: 789877 - protein, 85 aa, Homo sapiens
TLGPVCGRWSSLPAPAPAFPMGLRPGLEDLPQPRLALWPGDRPGFPGPGPLRSAMDKCKMPRTPFLGSAQMGPGPASPPGRLAAA

SEQ ID NO: 789878 - protein, 36 aa, Homo sapiens
MRTPWGTAKSGRGIAAGGVWGKPAWAGAVGLGLLLG

SEQ ID NO: 789879 - protein, 163 aa, Homo sapiens
MTSAPPLPYDAPPPAAVRAPLCSPPPSLPPVRLFPLRPRSAADRLLPPVVTSGDTLSCTLRPSLSLPLPPPCLPLSTRSRFLSTLSFPPPPSSASPARLLPPAPFFTPPASPPPLPVLFALSLSPTSPPSPGSSVLVLPLSSLCSSTASLSPHFCPDRVLTSL

SEQ ID NO: 789880 - protein, 60 aa, Homo sapiens
ELLHGKRKSQQSEQTTHRVGEEDVKVVHKHEKMLNITNDQGNVNQNHIATPPYTCKNGHN

SEQ ID NO: 789881 - protein, 237 aa, Homo sapiens
VFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVRKYVIHSP

SEQ ID NO: 789882 - protein, 971 aa, Homo sapiens
VFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPNGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAVKPPGLAATTATESPASSSRSPGGRK

SEQ ID NO: 789883 - protein, 157 aa, Homo sapiens
MEDDDIGAAIFSPYTILYDYKVLKKVTVIACDIWGISNIFTEYTLKLAQSSGVNDSTLHSTPTPIKKQQDSTVKNTGFEAMFFVTKKKKTVLLCRPGWSAVAHSWLTATSAACVKPFSCLSLPRSRDYRHPPLHPTNFCIFSRDGGLIMLATLVSNS

SEQ ID NO: 789884 - protein, 117 aa, Homo sapiens
ISLRLLPALHSHRKLYQNRPGQCVSGNPFQSPNLAGVLLQLGRWLKRQRKRLFIMAVYSQHGRSGKALLRLTSSSFHLLTKLPSDQASKEHNSDKAAGEGFPHCSAHPAHVLLSQTF

SEQ ID NO: 789885 - protein, 91 aa, Homo sapiens
MGYEIYVLGMPPPPILLQALIAWTKNPELSGRPFTVSDRGVLDRRQLYLTTSARDFRFYPKTELSGYPRKDSLTYWSFEETPQVWSHGPQR

SEQ ID NO: 789886 - protein, 165 aa, Homo sapiens
GKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPS

SEQ ID NO: 789887 - protein, 37 aa, Homo sapiens
QIVMNSLRSFWKVHILTQQVLESAFLMSTQVMFVLVL

SEQ ID NO: 789888 - protein, 126 aa, Homo sapiens
MSDHFTFLPHGELTHWGIFFPLEKCGYWKFPVIGKNRIGGALWGVLLPSSLLKASWCSGSTSDTRRRFSFILRPHSISATQISSGSGASTFRGSSSNDSSDSSHHSLFLFQQKDLCGGLGSTPGAE

SEQ ID NO: 789889 - protein, 77 aa, Homo sapiens
GEFRSHLGCGSFHLFIQQPLMLAESQAPSRVLGTQQAGRQTEPHAVEPADGQGWSVPGTWLGSGEPRRCPQEWGSWA

SEQ ID NO: 789890 - protein, 66 aa, Homo sapiens
RAKNTTSKTWLHGVVSESHLRRLLLSQFRFNTNDHVMQKDAYAYSVCIFDNRRDRLYYASSFVERQ

SEQ ID NO: 789891 - protein, 108 aa, Homo sapiens
GWRALRPGCLSGPRWRRSGEVRSPRLRAVIREIPALRWRNSDALGSVSRSLLGVRTLWADVDRAPATWVEWTDGTRLTHGPSPATYRGLPCCAFQGGNLELGGGENGA

SEQ ID NO: 789892 - protein, 82 aa, Homo sapiens
CCCSGTVKRERRQQTRGFVLQSMEEKAYKDTGICHFSTFIVVQWSGACCDVLSKIKDKFLYLVCPITKKEAQFLLGFFKFCS

SEQ ID NO: 789893 - protein, 159 aa, Homo sapiens
VTWVGRWRLPQTVRAGLEIFACSLLLCSTGNIHSVSAPRTYISFLGSSPFPFIFFLEIHRRLQLTGSSQQLRRCPVSPLCTRRVEEGTREGLILGKRTGGSPCAFLISIWARLRVEEEMFLEDVAYCSFLLGVPIERISSLLIERTDGMILTNPRRAAG

SEQ ID NO: 789894 - protein, 189 aa, Homo sapiens
MVSISRPRDPPASDSQSAGITGMSHRARWLACFLKKLQKFPNIFFQIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTAIDWYRLSVYGGEVATHE

SEQ ID NO: 789895 - protein, 129 aa, Homo sapiens
MVSISRPRDPPASDSQSAGITGMSHRARWLACFLKKLQKFPNIFFQIIVGGVASTSQDMHTYAACTFLAASMKEGKQGIQRNQESVQLGAIEACVMWLLENEFIQSTEASDGTEGKCDFSVAIYSLFLL

SEQ ID NO: 789896 - protein, 129 aa, Homo sapiens; identical to SEQ ID NO: 789895

SEQ ID NO: 789897 - protein, 129 aa, Homo sapiens; identical to SEQ ID NO: 789895

SEQ ID NO: 789898 - protein, 79 aa, Homo sapiens
SSDPPSAVQSAGITGLSRHTRPNTLSPFMAYPPTATSKIRNVSGSMLAPCLESSRVFSHLPPMTCETFCAPLPPASCDL

SEQ ID NO: 789899 - protein, 118 aa, Homo sapiens
TRRARQDAAVPSRVDLAPGRPEDAAQKPCGPRDAGLRGCSAPGEAPGIPSWRGLARPPGRSAGSAGEASRAGARDPRAPRAGAAWAGARVGLRRCGKCRLPVDAEGGVARICCGLLEK

SEQ ID NO: 789900 - protein, 144 aa, Homo sapiens
PFHSIPFHSTLVDSIPFHSTRIHSLLFHSERFHSIPFHSIPFHSIPFHSIPFRSIPFYSVSFHSIPFHSIPFHSIPFHCTRVDSIPLHSIPFHSIPFRCIPFHYIRIDSIQLPYSPFHSIPFGLFHSIPFHSTPFHCTRVDSIP

SEQ ID NO: 789901 - protein, 116 aa, Homo sapiens
MQLPDITVHVPGVCTPLISVVISRVNMTPHITQCAHPVIFFIIFKGDSASNITVGVPHVCVLCDSIFYIPREVLLVMSQWGVHPVMSFLFDLGAFFKPPYKRNGTDKKMLRLDCAA

SEQ ID NO: 789902 - protein, 185 aa, Homo sapiens
MYFCWGADSRELQRRRTAGSPGAELLQAASGERHSLLLLTNHRVLSCGDNSRGQLGRRGAQRGELPGERGAPGAGCEDPSDMGAGAWVPGAGNRVRSAGTRVRGAGAQVQGAAQMLGAAGQAGRGAGSLGFLGARRATGTRKMVPCATEEQLPQFRFPNAPRICFGFQFKFKAKLRAETNLVSAA

SEQ ID NO: 789903 - protein, 305 aa, Homo sapiens
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHT

SEQ ID NO: 789904 - protein, 201 aa, Homo sapiens
MAVESYPQKDSGIDIGDITARKALRKQLQCKTFRWYLVSVYPEMRMYSDIIAYGVLQNSLKTDLCLDQGPDTENVPIMYICHGMTPQNVYYTSSQQIHVGILSPTVDDDDNRCLVDVNSRPRLIECSYAKAKRMKLHWQPLRELTHPEPKSKRCLKLQGNSDLEFGFQLVLQTCSGQQGSITNVLEEPRVLTQRGHFRVPL

SEQ ID NO: 789905 - protein, 759 aa, Homo sapiens
RGFPSSAGRSDRQGSRRWRWEAAWPPTQAVAKFPRRTHLDARLPATRDPSRKGSGIFNLEKNPPGFLCQGLSGWPAAGAANLGTAATPAADRALENLGTQVLRCPAAPDVLRGASAGEFGAHDKEGPPGALLWRKEPRMVCTRKTKTLVSTCVILSGMTNIICLLYVGWVTNYIASVYVRGQEPAPDKKLEEDKGDTLKIIERLDHLENVIKQHIQEAPAKPEEAEAEPFTDSSLFAHWGQELSPEGRRVALKQFQYYGYNAYLSDRLPLDRPLPDLRPSGCRNLSFPDSLPEVSIVFIFVNEALSVLLRSIHSAMERTPPHLLKEIILVDDNSSNEELKEKLTEYVDKVNSQKPGFIKVVRHSKQEGLIRSRVSGWRAATAPVVALFDAHVEFNVGFLHRAEPVLTRIKENRKRIISPSFDNIKYDNFEIEEYPLAAQGFDWELWCRYLNPPKAWWKLENSTAPIRSPALIGCFIVDRQYFQEIGLLDEGMEVYGGENVELGIRVWQCGGSVEVLPCSRIAHIERAHKPYTEDLTAHVRRNALRVAEVWMDEFKSHVYMAWNIPQEDSGIDIGDITARKALRKQLQCKTFRWYLVSVYPEMRMYSDIIAYGVLQNSLKTDLCLDQGPDTENVPIMYICHGMTPQNVYYTSSQQIHVGILSPTVDDDDNRCLVDVNSRPRLIECSYAKAKRMKLHWQPLRELTHPEPKSKRCLKLQGNSDLEFGFQLVLQTCSGQQGSITNVLEEPRVLTQRGHFRVPL

SEQ ID NO: 789906 - protein, 132 aa, Homo sapiens
IPVAHTAAVLYHLGIGAVTEVCLAPGVSSHGSPLSLRLSCHQTTPAQWPHISRLSWEQLLALFLGGQQRWSCSTCSSPSCFGLELKQYPAFWENSTLNTQSNHASPVSQLKQRHASQEVVHWPSRVITHPST

SEQ ID NO: 789907 - protein, 420 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQQSK

SEQ ID NO: 789908 - protein, 447 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQTINRTEECLSESLP

SEQ ID NO: 789909 - protein, 186 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFAR

SEQ ID NO: 789910 - protein, 436 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTIQSQDRIMILHQLLCQYMTAAAPMQGTYIPQYTPVPPTAVSIEGVVADTSPQTVAPSSQDTSGQQQQIAVDTSNEHAPAYSYQQSK

SEQ ID NO: 789911 - protein, 160 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKLQERDPAVTKRLKSVTFLCMSRSLRIC

SEQ ID NO: 789912 - protein, 430 aa, Homo sapiens
MGKRLDQPQMYPQYTYYYPHYLQTKQSYAPAPHPMAPPSPSTNSSSNNSSNNSSGEQLSKTNLYIRGLPPGTTDQDLIKLCQPYGKIVSTKAILDKNTNQCKGYGFVDFDSPAAAQKAVASLKANGVQAQMAKQQEQDPTNLYISNLPISMDEQELENMLKPFGHVISTRILRDANGVSRGVGFARMESTEKCEVVIQHFNGKYLKTPPGIPAPSEPLLCKFADGGQKKRQNQSKYTQNGRPWPREGEAGMALTYDPTAAIQNGFYSSPYSIATNRMIPQTSITPFIAASPVSTYQVQSTSWMPHPPYVMQPTGAVITPTMDHPMSMQPANMMGPLTQQMNHLSLGTTGTYMTAAAPMQGTYIPQYTPVPPTAVSIEGVVADTSPQTVAPSSQDTSGQQQQIAVDTSNEHAPAYSYQYHNTMRLLTLTGY

SEQ ID NO: 789913 - protein, 107 aa, Homo sapiens
IEQSGGSPSLCSCPRVEGAQRFPLCYLRIGGVGWARWLTPVIPAFWEAKAGVSLEVRSLRPVWPTWQNPVSTKNTKISWARWQAPVIPATWKAEAGESLELGRQRLQ

SEQ ID NO: 789914 - protein, 78 aa, Homo sapiens
GKLTVHPSVCGQRPKSPQQTNGVSAGIQRLKNLKYDVQGQEEQEEASSIGKGKARRPSKQSYPTFFPLLCLCCTAASW

SEQ ID NO: 789915 - protein, 68 aa, Homo sapiens
LRNLIPVSLLMDSSRISNLAGLVCRLGFTDRYHKVSSVKTLCARASEVWSASSASWSEVGPAGVSYLE

SEQ ID NO: 789916 - protein, 104 aa, Homo sapiens
ETEARTGAETKRKTHRCKGPTSQASGNGVDINDSLVMPAGDPRGREERTPLSALGPQQALGEGTEVFHMIPVLNSQLQGEKYSCNNMPKKVNTSKIIPLTFNSA

SEQ ID NO: 789917 - protein, 104 aa, Homo sapiens
SVGITGMSHLHTQPPEYINNSYNFIIQRQMAQFFKWVSNLNRYFYKDVQMTSKCMKKCSKSLVFREMHIKITMKYNFTLTRMTGIIKSDDEFWQVCGQSRILRH

SEQ ID NO: 789918 - protein, 142 aa, Homo sapiens
LLSGPVRAGFHPTKGSGETRVQIPRAFGAGRRSSTSSVLQVGSGLRSGVWVSGSSSQAICVTPVRVESSEATAISQEKSQEEERMAVGLLKAMYQELVTFRDVAVDFSQEEWDCLDSSQRHLYSNVMLENYRILVSLGKDIF

SEQ ID NO: 789919 - protein, 103 aa, Homo sapiens [sequence omitted]

SEQ ID NO: 789920 - protein, 75 aa, Homo sapiens
VLRVAGVLDSTGRGWVELCDSGVLRVAGVLDSSGRGWVELCDSGVLRVAGVLDSSGRGWVELCDSGVLRVAGVLD

SEQ ID NO: 789921 - protein, 250 aa, Homo sapiens
MEIPKLLPARGTLQGGGGGGIPAGGGRVHRGPDSPAGQVPTRRLLLLRGPQDGGPGRRREEASTASRGPGPSLLAPRTDQPSGGGGGGGDDFFLVLLDPVGGDVETAGSGQAAGPVLREEAEEGPGLQGGESGANPAGPTALGPRCLSAVPTPAPISAPGPAAAFAGTVTIHNQDLLLRFENGVLTLATPPPHAWEPGAAPAQQPGCLIAPQAGFPHAAHPGDCPELPPDLLLAEPAEPAPAPAPEEEAE

SEQ ID NO: 789922 - protein, 104 aa, Homo sapiens
RFSAFWLRSSVGSVLNSLISDIFSIRVQYIKWIWGAGRRNRSLLVHFTHRSGIAVPPGTVHPLRGLKFNVQNRRRKKKQSVYVGWDTKEWDKNYLLAGRGGSHL

SEQ ID NO: 789923 - protein, 80 aa, Homo sapiens
KKTIQGKPIKEPGLPVFPAAISACDSPGEMSFMTLQLTWNPPPRARGSTSSRARALPGIALSTGHFTHWAGPLTGVNKEA

SEQ ID NO: 789924 - protein, 105 aa, Homo sapiens
MTIPPRPLACLAGPSPKALCHSNNQQEIVGCVSSVGIYEKSLHMFCHHGAARTRFASLADLRSWVRVHRHLSLAPHCLLRAIYHNSAVSCMLSSCILRTLNSLPR

SEQ ID NO: 789925 - protein, 68 aa, Homo sapiens
DCYQSQTLSRGEGVYRTKQVLATEHGREMGPQSVYELTENEEENVDVIQLAEINQIRFSGTWQNGNSK

SEQ ID NO: 789926 - protein, 112 aa, Homo sapiens
MPLHSSLGDRAKLCLKTNQPKTKSLSHSRVYCSFIHKCLDVSVNRYMDRENVYIRNRILSDLKKIHITNPYPTPNTQLPIQLNHSHTLSHVAEFRANLASPKASRLLHCPPF

SEQ ID NO: 789927 - protein, 116 aa, Homo sapiens
MKLQNGRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNR

SEQ ID NO: 789928 - protein, 91 aa, Homo sapiens
MSNSLPLHIFRFFSLYCDIVFSNCFKVRFTQAKLKLCNQMHCENLPTHNLKKLNNKNIKFQQFLKLGLFHTYCISPKKQVILAVVTVFGCF

SEQ ID NO: 789929 - protein, 103 aa, Homo sapiens
HIVAHTHRRTHTAKHTDRQMHIQTGRHRQADTHSFMQTQADTQPCAHRRTRTHNRTPTQTHSHMHRQADTHSCMHTQANMHTGGHIQADTHNHMHTQVDTQSH

SEQ ID NO: 789930 - protein, 109 aa, Homo sapiens
MLREVGVLVLENCRMDAEIHYCARRGRGRRRELVRDTLQPRGLPGTSSSPGRLGAGRGRIHTAELRPRCSQPLFRERPLRTHSRPFLTSMESLALRERAKKQINKQQTN

SEQ ID NO: 789931 - protein, 103 aa, Homo sapiens
MASRWAVQLLLVAAWSMGCGEALKCYTCKEPMTSASCRTITRCKPEDTACMTTLVTVEAEYPFNQSPVVTRSCSSSCVATDPDSIGAAHLIFCCFRDLCNSEL

SEQ ID NO: 789932 - protein, 48 aa, Homo sapiens
MEKMGQGIHSHPTPPNPDPPLPQISLEKSLCFNKDGELPSWNSVGKLP

SEQ ID NO: 789933 - protein, 120 aa, Homo sapiens
MCQAPSHMSGVQHIPTLSPLGSSFIPITCPCWGGVQSGPSCLTLEIQSQMTGSKTPSQRHDIWNQTTWAQVSALLCGLGKLILLSFLQFSQAYNGDNNATFVRVFLRTKYERLRTVPGAH

SEQ ID NO: 789934 - protein, 112 aa, Homo sapiens
MCYLSSRQEVVTAFDVTIRAEERQEATFSCSPLLEDSLLHKCVHLNRRWSCAPCSYMSPPPLISWASQRWCTSVTSSEGLRDSGSKVEFTSASSSRQPGEIVPPSVRRQCRC

SEQ ID NO: 789935 - protein, 77 aa, Homo sapiens
HAPSSGIRMALACHQPPQAPLGSLRIGPCSLLLPLSHTNHLGAWRLTYSVHHCYCTANTTHNAQSPEDPPAQLTTGT

SEQ ID NO: 789936 - protein, 91 aa, Homo sapiens
MLGEGVSGLLGGQAGASGQELRAALGNHPELLFTHQGQCQGGLGSQQSPEEGAQAEQELPDSLAPEATPHCGRLVTEAIFTAGHVQLLNLR

SEQ ID NO: 789937 - protein, 105 aa, Homo sapiens
MANVLAFLFCYQQVSSVHTWVLSQARVTGLHHHSLCDPGLQVAPPLSAAVPPQSPHSGATGVTDQADSSRQCLRSHSRSLINPVVTSSVMLEVTCSDTQASLSTG

SEQ ID NO: 789938 - protein, 129 aa, Homo sapiens
QHTQGLLPESAKHIAFLSVDGTQSSIFLFSSGEKIKSLYVNMIDIHCAKKISVFLKKYKGKGKLICPSVTLRHTLVTSVQAPFQDSECTVYMNAYTEKFTFKSVLYLFFYNIRNRFLLRCLHVGNYRTT

SEQ ID NO: 789939 - protein, 102 aa, Homo sapiens
MTMTIIVLAIVPPLPNIYPGCAPHVLLPGVLLFSPSNFSKPHTCSLISPACKNCLPLPFLGLNNLFPLPLPHPRPIISRSMSSCQIPSPVPNMPCNKIREDK

SEQ ID NO: 789940 - protein, 106 aa, Homo sapiens
MCVSMSISLQKEDVGDSSPMHSDFSLTKFVMVGGTPHYCGSAGIASVNMPREGLLLGNGERQRGEKNIIGTLNVTQQHFFCCFKVTSFYNAFKFTCLVICSKMGSP

SEQ ID NO: 789941 - protein, 103 aa, Homo sapiens
RPGLPLAPRPFESSPALSIGRAPWRVRPAPPCLGAGRPVSGGNRVWRGGPERDVCHRLISAAQAPSQHTEPARSRPFPPSARSSVWGARWLGERDFFLSYKEN

SEQ ID NO: 789942 - protein, 104 aa, Homo sapiens
TICRPRPPEVPGLQAGATVPGLFFSFLNDLQLHIFLTKQLQDNQIPNETTPGWARYTWYNSKMHTRLPGSKLLHNSFVFFFPEIGSRSVMQAGGQWSDLGSLQP

SEQ ID NO: 789943 - protein, 150 aa, Homo sapiens [sequence omitted]

SEQ ID NO: 789944 - protein, 112 aa, Homo sapiens
SGCRVITELNPGLQIPRSVFFTRNQKRNISTVIINIFFFLRQSLALSPRMENSGTNLVHCNVCLTGSSDSRASASQVAGTTDAGHRVWIICFFLVETEFCHDGLAGLNLLAS

SEQ ID NO: 789945 - protein, 93 aa, Homo sapiens
RAEEPVGGVSTREAEALRCEARILLQALCLQQEVALGDSSPWGTALHGLGHPCSQTTASAVLPDESQSPAYREATLMPKTSRPQQCSQGCGTR

SEQ ID NO: 789946 - protein, 93 aa, Homo sapiens; identical to SEQ ID NO: 789945

SEQ ID NO: 789947 - protein, 119 aa, Homo sapiens
MLCCFQACSLKVLGSFCLGLFVPELLYKNLTTLLERPCGEDLTLYAEVEGPWLVQPSSHPVKIADPFPALLLFYSVLQPTTFPGSLVLCYLGEFCQWKTLVEGWMLLLLASLVVAVFPP

SEQ ID NO: 789948 - protein, 136 aa, Homo sapiens
MDLFLWLQICESIRKVIWYTSTEWILFKKECPTSVTMAKLKVYSVPQHAVGIVVNKGKILAKRINVHIEHIKHCKSRDSFLKCVKENDQKKKEAKEEGTWVQVKHQPAPPREAHFVKACGKEPELLEPIPCEFMAS

SEQ ID NO: 789949 - protein, 338 aa, Homo sapiens
VRRVLATETFPCHTEKVQQAVCLQVYKETSDHLLEGKKLKCYIRCCVLHNSQKLQILYKSLEKSIPESIKVYGAIFNIKDKNPFNMEVLVDAWPDYQIVITRPQKQEMKDDQDHYTNTYHIFTKAPDKLEEVLSYSNVISGSKLVQIQGCQEGLDEAIRKVATSKSVQVDYMKTILFIPELPKKHKTSSNDKMELFEVDDDNKEGNFSNMFLDASHAGLVNEHWAFGKNERSLKYIERCLQDFLGFGVLGPEGQLVSWIVMEQSCELRMGYTVPKYRHQGNMLQIGYHLEKYLSQKEIPFYFHVADNNEKSLQALNNLGFKICPCGWHQWKCTPKKYC

SEQ ID NO: 789950 - protein, 294 aa, Homo sapiens
MLVLHNSQKLQILYKSLEKSIPESIKVYGAIFNIKDKNPFNMEVLVDAWPDYQIVITRPQKQEMKDDQDHYTNTYHIFTKAPDKLEEVLSYSNVISWEQTLQIQGCQEGLDEAIRKVATSKSVQVDYMKTILFIPELPKKHKTSSNDKMELFEVDDDNKEGNFSNMFLDASHAGLVNEHWAFGKNERSLKYIERCLQDFLGFGVLGPEGQLVSWIVMEQSCELRMGYTVPKYRHQGNMLQIGYHLEKYLSQKEIPFYFHVADNNEKSLQALNNLGFKICPCGWHQWKCTPKKYC

SEQ ID NO: 789951 - protein, 775 aa, Homo sapiens
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 789952 - protein, 181 aa, Homo sapiens
VCTVHEDPAGRVPAQQVTDERQDHEQGLRGSRQGQAGQPLGEGGHQVGGEVGGGQEEVSQVEEAGAVLDVKDRGVQEARRASGRSQGLQVVFVNQDEQPVQGQEAEGPPGSARSRRPGSPFRALRPSSTARARVLSPATAHQRDPAAGPGSGASFCVRVPRFPAELRRRTRSPRGRRGGGG

SEQ ID NO: 789953 - protein, 163 aa, Homo sapiens
YPAFGGSPNPAERHVCSERLLHTSRDFIRSLPRVRSGSAGNKENARTWRRSEGGLAGPPLAKAPRSHSPPGCSPHGQSLPPRRRTPPSQLTGSARSRRPGSPFRALRPSSTARARVLSPATAHQRDPAAGPGSGASFCVRVPRFPAELRRRTRSPRGRRGGGG

SEQ ID NO: 789954 - protein, 146 aa, Homo sapiens
MSRSRLFSVTSAISTIGILCLPLFQLVLSDLPCEEDEMCVNYNDQHPNGWYIWILLLLVLVAALLCGAVVLCLQCWLRRPRIDSHRRTMAVFAVGDLDSIYGTEAAVSPTVGIHLQTQTPDLYPVPAPCFGPLGSPPPYEEIVKTT

SEQ ID NO: 789955 - protein, 63 aa, Homo sapiens
MVLDANIWVSMVLEANIWDSGAIKGSTPTVTEVSPTNVVGSSCATVLIGFQRCRRGHTPGNAT

SEQ ID NO: 789956 - protein, 63 aa, Homo sapiens; identical to SEQ ID NO: 789955

SEQ ID NO: 789957 - protein, 30 aa, Homo sapiens
MFIGNTGGRGGCTDRSNVAVDAAANLVVVG

SEQ ID NO: 789958 - protein, 85 aa, Homo sapiens
FRSYEPSFPKVLSNCAFGGGIALVGFFFARKICERNCYYVNSENSLPNKEEDVFLQEPGFSWIVSVSDEDLRMALERSPDLSFAL

SEQ ID NO: 789959 - protein, 129 aa, Homo sapiens
MRRIIGIVFQCLCGLSLASTVFGRNRSGDSLPASDRPPISSPLATSGTIFSAISCFWDLPAPFLWLAPSCQPTMSSQIRQNYSTDVEAAVNSLVNLYLQAFYTYLSLVSPQDAPGPNFLQLRTSGPPLA

SEQ ID NO: 789960 - protein, 125 aa, Homo sapiens
CSPWPESPARPRPPLSSLALTSPHSCRLLSPERLCSSPPFALDTLGCSPVEDLNQKAPISETQQWLHQHWFSSYCRMLANFTGLDLLKLTCQDLIQICGAADGIRLFNTLRARCWTLPTRVPFPL

SEQ ID NO: 789961 - protein, 88 aa, Homo sapiens
PLSVGVIEPQVLLSQLNMVEFHWDPTKRTSLFLQFTPRKKGGEKGIPFRLQIDTFRPSDKGLPLDHLHSAGCLIKVFKHKGAETENGP

SEQ ID NO: 789962 - protein, 103 aa, Homo sapiens
SQLLGSLRRENHLKPEGRGCSELRDRATALQPEQQEQNSVSKTNKKPVMSFISWKWDCCLKLVMIIITFEQTQRVPMQHPPWLSFILRHLIILYATKKEKICY

SEQ ID NO: 789963 - protein, 108 aa, Homo sapiens
TSLHSHQQWRSVPLSPHPRQHLLSPEFLILAILTGVRWNLRVVLICISLMIKDVEHFFKCFSAIRYSSGENSLFSSEPHFLMGLFDFLKSTFLSSLYMLDISPLSDLG

SEQ ID NO: 789964 - protein, 131 aa, Homo sapiens
MEWNHPEWNGMEWNGIEWNQPECNGMEWNGMEWNGTTRMEWNVMESKGVNRINPNVMEWNATEWNGMECNGMEWNGMEWNGMEWNGMIRNRMEWNEMEWNGMEWNGMEWNGIVPSGIGGNVFEWNGKEWNQ

SEQ ID NO: 789965 - protein, 76 aa, Homo sapiens
IFSSFKKGDCDKTYGSEFVYSDHAKELIVGEIFVRVYNEVPTFQLEVPKAFAASLLDYIGSQAQYLHTFMAILFSW

SEQ ID NO: 789966 - protein, 941 aa, Homo sapiens
KQVSNFNLLCHETPSGSLQRTTGSPRVRYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRSSKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 789967 - protein, 256 aa, Homo sapiens
GRVGRPTRRRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 789968 - protein, 1194 aa, Homo sapiens
MLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRSSKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 789969 - protein, 802 aa, Homo sapiens
MLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRSSKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSMYTDGILETTARLAHGKELLHS

SEQ ID NO: 789970 - protein, 321 aa, Homo sapiens
MLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPNFGYRA

SEQ ID NO: 789971 - protein, 1194 aa, Homo sapiens; identical to SEQ ID NO: 789968

SEQ ID NO: 789972 - protein, 440 aa, Homo sapiens
GDQRWSARPARAESTWRTGSSSVSGSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 789973 - protein, 215 aa, Homo sapiens [sequence omitted]

SEQ ID NO: 789974 - protein, 630 aa, Homo sapiens
MLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRSSKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKVCYCFINFLGNLF

SEQ ID NO: 789975 - protein, 75 aa, Homo sapiens
EVANSLAKLSVHALSRLGGYLAEEQATPENPTIRKSLAGMLTPYVARKLAVASVTEVCASQVAWVLINSARSFKQ

SEQ ID NO: 789976 - protein, 160 aa, Homo sapiens
MKFCSCSGFTAKEASNYQNLRMHQIISMMMEGNFKTQLRQVEMNYQVGLLLYGRQSCVQICTLLGINENFFSTNCVYITILGTYKQTVDNVLTLLGLMIHRRLKDKAKAVQHDKCLINVVGLAQGFLTRKPVLGRNTRFTYRPFSQFTILLFFPPFFVDC

SEQ ID NO: 789977 - protein, 168 aa, Homo sapiens
SAPPEKGAEGRTEKGEGRINPSLATPLSGPDIAEPSGAPRSQRGAPEAAPARPRCAGRGGAQVRSGATRSPRLRLTSGRPGSAAPRAIHPGAAPQTPRGAGENLKEVVARLDILKTRINWENRKGASKRGEDIPGWGRMSFKNYIPLLWRLFLTFPTIKRNVATFNFC

SEQ ID NO: 789978 - protein, 264 aa, Homo sapiens
MPLASSSNVVGRKTGKGNFGGQNEQEDTLNQLLVEMDGFNTTTNVVILASTNQPDILDPALLRPGRFDRQIFIGLPDIKGRGSIFKVHLRPLKLDSTLEKEKLARKLASLTPGFSGADVANVCNEAALIAARHLSDSINQKHFEQAIERVIGGLEKKTQVLQPEEKTVAYHEAGHAVASWYLEPTDLLLKVSIIPRGKGLGYAQYLPKEQYLYTKEQLLDRMCMTLGGRVSEEIFFGRITTGAQDDLRNSNSECICPNRTVRHE

SEQ ID NO: 789979 - protein, 124 aa, Homo sapiens
QWKLCDGDKHGNHSDVTQLNLHLKKWMPRQHKQDPGTPTGYGAVPQSQGPGFLPREVRNKDNFSLLPLSSPDTDLPTLYLPLLLPNPHPVLSRRHHCLQGMHSAAHCTQTTNSQKVMTICVWDV

SEQ ID NO: 789980 - protein, 1521 aa, Homo sapiens
MQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPAAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDALGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 789981 - protein, 1380 aa, Homo sapiens
MDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDALGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 789982 - protein, 1280 aa, Homo sapiens
MQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPAAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDALGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGNPKGGGGVFTPPLFGGGPFF

SEQ ID NO: 789983 - protein, 143 aa, Homo sapiens
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYRCARPRHLHHHRVQPPRLPDN

SEQ ID NO: 789984 - protein, 1580 aa, Homo sapiens
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPAAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDALGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 789985 - protein, 1489 aa, Homo sapiens
KRSKIKPDEDLPSPGARGQQEQPEGTTLVKEEGDKDESKQEPEAIYETNCHWEGCAREFGTQEQLVQTSALSSSPTYPDLPFIRISPHRNPAAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDALGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 789986 - protein, 773 aa, Homo sapiens
MQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPAAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGHHSNKHLATWGGPIEPFSPGA

SEQ ID NO: 789987 - protein, 156 aa, Homo sapiens
MHFQKVRTKEEKEDNLPKASQCQKQSNSKDYALSLHHAVLYLQDTFFLRQVLTWSSRLESSGTITTHCGLELLGSGDSPTLASQVAGTTGMCHYTQLYFVFFVETDFHHVAQAGLELLDSSNPPASASQSAWNYRHETLLLADNYSYCYKSGKEYD

SEQ ID NO: 789988 - protein, 83 aa, Homo sapiens
RWDIDAVMLMMVVMVMMVVMDATTAFSSLLPVAKWLSFAEHLPCSSRCCAYLISSSAQAHNAGTIIHILQMRTLRCRVVSDPF

SEQ ID NO: 789989 - protein, 151 aa, Homo sapiens
DADDGGDVDEGSDAVDGGDTDDGGDADDGGGILITAVMLMMAVILMIAVMLMMAVMLMMVMMAVILMMVVMLLMAVMLLMAVMLLMVVMLMAVMLFMAVMLLMVVDIDNSSDADDGGDAVDGSDAVDGNDTDDGGDADDGDDADDGGDVDE

SEQ ID NO: 789990 - protein, 156 aa, Homo sapiens
QLLLIFILSNTDCYKIKVDYLRVFQTLINLGEYFGLIGQKVSSFVFQVKWRVLYSVYQKKSSSLGTIPHMLNQISHLKSVPTQFLHFQAVNPTYRSPQVCFCTFLKRVEGVDGRDKMRGFAVRPSIYSTHFSQVSLGSGHRTRCWEGGSNGEGLRN

SEQ ID NO: 789991 - protein, 81 aa, Homo sapiens
RRKHSRSEVARGRRCLSPAARLGPWPPTPTAPALGGPGPAAGAALPDQSFLWNVFQSCHLAPPRTILLVLDSQVAPDGSFD

SEQ ID NO: 789992 - protein, 132 aa, Homo sapiens
RRKHSRSEVARGRRCLSPAARLGPWPPTPTAPALGGPGPAAGAALPDQSFLWNVFQSCHLAPPRHLPPPPQLPRTRVPTPAANPVPCRLPRGLPRHLPGPQRPPPSPAPTSAVSPAPARTPAGAPEPYPDRR

SEQ ID NO: 789993 - protein, 195 aa, Homo sapiens
MALVTVQRSPTPSTTSSPCASEADSGEEECRSQPRSISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWVDRDSRNKHCDVLLVEE

SEQ ID NO: 789994 - protein, 202 aa, Homo sapiens
MTLSTLARKRKAPLACTCSLGGPDMIPYFSANAVISQNAINQLISESFLTVKGAALFLPRGNGSSTPRISHRRNKHAGDLQQHLQAMFILLRPEDNIRLAVRLESTYQNRTRYMVVVSTNGRQDTEESIVLGMDFSSNDSSTCTMGLVLPLWSDTLIHLDGDGGFSVSTDNRVHIFKPVSVQAMWVDRDSRNKHCDVLLVEE

SEQ ID NO: 789995 - protein, 70 aa, Homo sapiens
RRVKRLGLLLRNQLDWVSLIGENTYISIELPADFCILARFGASASLSHRNCTLIFVLYVSYSDTCSHPLP

SEQ ID NO: 789996 - protein, 62 aa, Homo sapiens
PRRDEETMPGAHTRQLLFENGDLRALFSSNCRGISGVGEETCFTSPTSGPVWKGWRRCGQVQ

SEQ ID NO: 789997 - protein, 84 aa, Homo sapiens
MGLVGPGISSQLAVEFSRGTGPACSSIFIIFNRSRFFLLPSGYWEAPGKSWDSGVPQYGLPALGQQGQFGFLSNILAGCRGSCL

SEQ ID NO: 789998 - protein, 126 aa, Homo sapiens
EAVPGRAGSCGTAMAEPASVTVTFDDVALYFSEQEWEILEKWQKQMYKQEMKTNYETLDSLGYAFSKPDLITWMEQGRMLLISEQGCLDKTRRTTSPPTDEQLNMKNTGKLLCFGDEGTPRTEEDC

SEQ ID NO: 789999 - protein, 134 aa, Homo sapiens
MGFDVLLDQVGGMGRFQICLIAFFCITNILLFPNIVLENFTAFTPSHRCWVPLLDNDTVSDNDTGTLSKDDLLRISIPLDSNLRPQKCQRFIHPQWQLLHLNGDLPPTQMSQTREPCVDGWVYDRKLFPLHHRD

SEQ ID NO: 790000 - protein, 131 aa, Homo sapiens
PPPGPLWQPTFFPSALRLFGVSQPPWKTLELRADPPPLQGKSLESTGSRRPGRLDLEAEQGGSEGRLGEGCTAEGPPTPKPKSRSAQLPAGRAAPGSALPPRAPRPSTPTRGAVTRGNRRPELSTSGPAPG

SEQ ID NO: 790001 - protein, 122 aa, Homo sapiens
RDHVTKFTSDQRHKSKKSSPGTQDLLGIQTGIQEKDIQMSQQILTVQEDQGSAYVDYSMTSCNHNALNNICYYRRGFVKRKLSPNEKEEKHRAQHLTHNKFLLNGCLIKNDHVKDLEFQNIT

SEQ ID NO: 790002 - protein, 119 aa, Homo sapiens
LVHSGFQAQSLGHQSPVLDLLLLSFYPVLPRCPLQLPLLGTGLSLYYLSHRQFAQLPSKSAPHGTQGSPFLPAFGLVQVLLRPPSRKGLLQGDYLSLSPEVPLSKRGIPPGHMTYPPDN

SEQ ID NO: 790003 - protein, 83 aa, Homo sapiens
QARSSNMDTEVLWGHRFTPVLTLEKGFYEVDYNTFHDTYETNTPSCCAKELAEMKREGRLLQYLPSPPLLGGCAEAGLDAEVF

SEQ ID NO: 790004 - protein, 83 aa, Homo sapiens; identical to SEQ ID NO: 790003

SEQ ID NO: 790005 - protein, 83 aa, Homo sapiens; identical to SEQ ID NO: 790003

SEQ ID NO: 790006 - protein, 83 aa, Homo sapiens; identical to SEQ ID NO: 790003

SEQ ID NO: 790007 - protein, 106 aa, Homo sapiens
LVKTCGSMPQDDLRRLGLPKCYNYRREPPHPAWIFKFEISSGAVMFRRPSPSRDWLNTHFHFLLIFTVLHFIFNSLICIELTLKYQTNMFNAFVYLSSRSVFPATC

SEQ ID NO: 790008 - protein, 109 aa, Homo sapiens
STFFCHDFSRSLRLGSLTSRNKGGLPGPPRVQGCLGLQPRFGQLELCLGGWSSHLPLWALRAQGCLGLQPRLGRLQQHPGSSHPNLEGAGLALVPGFCLLHGACSPGHA

SEQ ID NO: 790009 - protein, 72 aa, Homo sapiens
ITTNTDPSCSCVTPLDFNHCLKNREDNGLPMLSTNAMSWKTISAMEKRGARETQQQRKRVFRGRGVNSAKCC

SEQ ID NO: 790010 - protein, 359 aa, Homo sapiens
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 790011 - protein, 135 aa, Homo sapiens
SPSIARRSRGPAAPPPARPGPGPARPPPRMELSAIGEQVFAVESIRKKRVRKGKVEYLVKWKGWPPKYSTWEPEEHILDPRLVMAYEEKYGVLGTAGWGLGPAQRLPRSLLLAWQGLLGQGRGVRWGRPAQPAAG

SEQ ID NO: 790012 - protein, 151 aa, Homo sapiens
YAHSLFSLVLNVGLKVSWTLVSALDWQLALPAHLNPQAAGHGKASGSLMSDSRLTTNDLHIVPYLEDMSEREDQNPTSTSERNQPAFTWQEVGSGICMGFPLQQTEAALACPLPTKLFWPWKGAHSSSIRYSLGRADSQGGSSFYSQGAGI

SEQ ID NO: 790013 - protein, 83 aa, Homo sapiens
LNVAGRGRILPKKAAADLLNVSEQSFFKQKSVTSKHNVNGFINLLNSSFCYLLGLNLFDLRTPLHCFKKVFENLKELFFGYIY

SEQ ID NO: 790014 - protein, 85 aa, Homo sapiens
EVEEPLSACGGASVLAVLMAPSSWGSLSSGPASPARPSCLLGARGASPGQSLCLGPASLAALPPAMGGRRGGSRPVLVFAELLVD

SEQ ID NO: 790015 - protein, 85 aa, Homo sapiens; identical to SEQ ID NO: 790014

SEQ ID NO: 790016 - protein, 111 aa, Homo sapiens
REKKMMMEIIISIIRLRLAALCPFRFEPLYREKLCQILYRSFLYHQVDIILKLCSLPWHHHNNHTATRKACPILVKHLGIGMQIDNKNKRLQNWEELGMVAHSCNPCFSGG

SEQ ID NO: 790017 - protein, 643 aa, Homo sapiens
MVDAGGVENITQLPQELPQMMAAAADGLGSIAIDTTQLNMSVTDPTAWATAMNNLGMVPVGLPGQQLVSDSICVPGFDPSLNMMTGITPINPMIPGLGLVPPPPPTEVAVVKEIIHCKSCTLFPQNPNLPPPSTRERPPGCKTVFVGGLPENATEEIIQEVFEQCGDITAIRKSKKNFCHIRFAEEFMVDKAIYLSGYRMRLGSSTDKKDSGRLHVDFAQARDDFYEWECKQRMRAREERHRRKLEEDRLRPPSPPAIMHYSEHEAALLAEKLKDDSKFSEAITVLLSWIERGEVNRRSANQFYSMVQSANSHVRRLMNEKATHEQEMEEAKENFKNALTGILTQFEQIVAVFNASTRQKAWDHFSKAQRKNIDIWRKHSEELRNAQSEQLMGIRREEEMEMSDDENCDSPTKKMRVDESALAAQAYALKEENDSLRWQLDAYRNEVELLKQEKEQLFRTEENLTKDQQLQFLQQTMQGMQQQLLTIQEELNNKKSELEQAKEEQSHTQALLKVLQEQLKGTKELVETNGHSHEDSNEINVLTVALVNQDRENNIEKRSQGLKSEKEALLIGIISTFLHVHPFGANIEYLWSYMQQLDSKISANEIEMLLMRLPRMFKQEFTGVGATLEKRWKLCAFEGIKTT

SEQ ID NO: 790018 - protein, 643 aa, Homo sapiens; identical to SEQ ID NO: 790017

SEQ ID NO: 790019 - protein, 643 aa, Homo sapiens; identical to SEQ ID NO: 790017

SEQ ID NO: 790020 - protein, 306 aa, Homo sapiens
TPSVFALLPYSDHNINYLSCLTSLFTKVEQIVAVFNASTRQKAWDHFSKAQRKNIDIWRKHSEELRNAQSEQLMGIRREEEMEMSDDENCDSPTKKMRVDESALAAQAYALKEENDSLRWQLDAYRNEVELLKQEKEQLFRTEENLTKDQQLQFLQQTMQGMQQQLLTIQEELNNKKSELEQAKEEQSHTQALLKVLQEQEINVLTVALVNQDRENNIEKRSQGLKSEKEALLIGIISTFLHVHPFGANIEYLWSYMQQLDSKISANEIEMLLMRLPRMFKQEFTGVGATLEKRWKLCAFEGIKTT

SEQ ID NO: 790021 - protein, 325 aa, Homo sapiens
TPSVFALLPYSDHNINYLSCLTSLFTKVEQIVAVFNASTRQKAWDHFSKAQRKNIDIWRKHSEELRNAQSEQLMGIRREEEMEMSDDENCDSPTKKMRVDESALAAQAYALKEENDSLRWQLDAYRNEVELLKQEKEQLFRTEENLTKDQQLQFLQQTMQGMQQQLLTIQEELNNKKSELEQAKEEQSHTQALLKVLQEQLKGTKELVETNGHSHEDSNEINVLTVALVNQDRENNIEKRSQGLKSEKEALLIGIISTFLHVHPFGANIEYLWSYMQQLDSKISANEIEMLLMRLPRMFKQEFTGVGATLEKRWKLCAFEGIKTT

SEQ ID NO: 790022 - protein, 216 aa, Homo sapiens
MVDAGGVENITQLPQELPQMMAAAADGLGSIAIDTTQLNMSVTDPTAWATAMNNLGMVPVGLPGQQLVSDSICVPGFDPSLNMMTGITPINPMIPGLGLVPPPPPTEVAVVKEIIHCKSCTLFPQNPNLPPPSTRERPPGCKTVFVGGLPENATEEIIQEVFEQCGDITAIRKSKKNFCHIRFAEEFMVDKAIYLSGTLHYIRSFLGILLCFVMLI

SEQ ID NO: 790023 - protein, 116 aa, Homo sapiens
GTADLPRPCAMVVPDFELICEIMLMAEGFLEARLLARKFITLYTLCKELLSKQDHYDWGLRAIKSVLVVAGSLKRGDPSRAEDQVLMRALRDFNIPKIVTDDLPVFMGLIGDLFPA

SEQ ID NO: 790024 - protein, 75 aa, Homo sapiens
TGLLQVFELANVHPPQGLRECRSLPWEVSPAIRGSPRHFLPIPIQLSKPMPKRPPVSRVPAHLSQCVLNALPSVS

SEQ ID NO: 790025 - protein, 111 aa, Homo sapiens
MNSAVTSREHSTYSQRSDVVLSSQPMAKAGGQIGSPGVRSSCLAYDILDILPCYLCIFLGIQHFLTALGGLMAVPFILAKDLCLQQDPLTQSYLISTIFFAPASACSCKCF

SEQ ID NO: 790026 - protein, 165 aa, Homo sapiens
KLGSFSKTLGIKLKKNMGGLGGLVHGKMGRANSANGKNGDSAERGKEKKAKSRKGSKEESGASASTSPSEKTTPSPTDKAAGASPAEKGGGPRGDAWKYSTDVKLSLNILRAAMQGERKFIFAGLLLTSHRHQFHEEMIGYYLTSAQERFSAEQEQRRRDAATAA

SEQ ID NO: 790027 - protein, 105 aa, Homo sapiens
MLCAIRNPTTDLSEEKYKLLLSSAHVNIGFTAETEPEQGLMMQSWELREQELDDVKGLPPLFPLLHPMCKVCELTPGSYGSICPPLVHLYHVAMKNVNKGPSNCE

SEQ ID NO: 790028 - protein, 44 aa, Homo sapiens
ISTSFLADEEFEAPSDEELTLSHIANDTESKPVIHETCICTHHL

SEQ ID NO: 790029 - protein, 124 aa, Homo sapiens
MKGSRSHRKLLRAGPGTGSDTFHQPPLLPPAPKEKAEPALGAWMGGQEPGFQARIPDGSPGALMGGQEPRCEARGPDSRPGAWMGGQEPRCEARSLAGSPGAQVGGQEPRCEARSPHGRPGAQM

SEQ ID NO: 790030 - protein, 101 aa, Homo sapiens
HLCSLPSVHCPESHAGWVPRTLGIDYLSLSAHMVYTVGLHQYKSPDPGQARCLTPVIPALWEAEAGGTLRSGVSDQPGPHDETPSLLKNTQKLAGRSGRCL

SEQ ID NO: 790031 - protein, 118 aa, Homo sapiens
LPNGSKITMYSDLFINSLLGNISIRKREEWCSCLGDLFISPSYLLSLYLAKARPCFTDFTFLSSIFTSDLRDTWFTHVKIPAHFSRQFIDISFCQYCWEQARVKYLIPFSLYSYTHKL

SEQ ID NO: 790032 - protein, 96 aa, Homo sapiens
HVEAVAQDFLLLSLHFRKTLQVRFQEHAFRRMERGVLLVIAKIKTEEIRGERMLIGFIGLVMWFFFFFETGSSFAVQAVVQWCHHGSLQPPTPELK

SEQ ID NO: 790033 - protein, 91 aa, Homo sapiens
FVCCVLVCVLCVRVCCAFVCAVRLCVCCVCMCVRVCAVRLCAVCACVCVCVLCVCVCAVCSSVCCVCCAFVCVLCSCVCCVHVCKITYLYI

SEQ ID NO: 790034 - protein, 96 aa, Homo sapiens
LFTAAVWGCGGQATKQGWLRARSAWDQSAGHLGTPQALSRFVGVRYLALGPDGRAGVPGCCVPTSTETSASTLCRACKVWPLCWTPWGTGLCRTRP

SEQ ID NO: 790035 - protein, 118 aa, Homo sapiens
MQLEYKSMFIGFYSYHSMYSIHVNYWMKSPIIYIFGYNHTILELKTIQVSVPAFSGYLMALHNHFHPNLAKSKFKHFCIYSKTNSLSCLISVTLTSREGTLPSISLPPLTFLTIKNIQ

SEQ ID NO: 790036 - protein, 74 aa, Homo sapiens
MAEAPGPSGESRGHSATQLPAEKTVGGPSRGCSSSVLRVSQLVLQAISTHKGLTLAALKKELRNAGYEVRRKSG

SEQ ID NO: 790037 - protein, 230 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMVDNTNVYDGLRSAYGHVYEHHETTHGGCRGRKTMNYCEDLARGTRGISAYAPGTAGPNEKLVALPITTWMNIANDWTNPEINKAAYTGAKAGTAVTGLRAFPLR

SEQ ID NO: 790038 - protein, 197 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMWTNCEDLARGTRGISAYAPGTAGPNEKLVALPITTWMNIANDWTNPEINKLSYTGAKAGTAVTGLRAFPLR

SEQ ID NO: 790039 - protein, 69 aa, Homo sapiens
WDAYRKLMGLPQSRVTDYRAKITQKFRPVGSKPGRRVESVLFCKKAGNADSIHCPDTPSLPLPAKAISQ

SEQ ID NO: 790040 - protein, 107 aa, Homo sapiens
LAGQHLWRAGVQWRNLSSLQPPPPGFKRFSYLSLPSSWNYRHVPPHSANFIFLVETGFHHVGQASLKLLTSGNLPASASQNAGITGLSYCASDTYLIFILRMCSKIL

SEQ ID NO: 790041 - protein, 37 aa, Homo sapiens
PPFPHKGLETTINTTTRAGDFVTDSYYILIVLGLRQF

SEQ ID NO: 790042 - protein, 111 aa, Homo sapiens
IPDCPRGEWWSYVIGTCSHTLLCTPPGSPKSPHAGSPHLSCSRKHVRKQSRRLLRGRHESTLVLKPFPNVLVDCVVLPKLPAAGAREVTPAGAAAGGSPRWLALFLFCFFF

SEQ ID NO: 790043 - protein, 127 aa, Homo sapiens
QRQDLTLLPRAECSGVVTIHCSLSFMGSSHPQSSHLSLPSPSWDCSVRHHTWLIFFLLFVETGSRHVAQAGLELLGSSDLAALTSQSAEITGMSHHTLPAFHFYVSTCAVCIQQLFFLFAFLFCPLL

SEQ ID NO: 790044 - protein, 67 aa, Homo sapiens
SCLPPLPETMTMFENVTRALARQLNPRGDLTPLDSLIDFKRFHPFCLVLRKRKSTLFWGARYVRTDY

SEQ ID NO: 790045 - protein, 117 aa, Homo sapiens
ERKGQYSRANKSILYQGRGKSSPELWIRINLQEGGEIAWSHLVSFLFSLAFFFVLSSTILKSVKYKHYRIGHLESWVLDLVWSAIINSVILDKPLGLLGPQSPHLEIRRQIILRVLS

SEQ ID NO: 790046 - protein, 112 aa, Homo sapiens
RSDGPLGSRAGAPGLPAPEAAPPPARLPPRCPVTLRRRGADVPAPMMRKSRLGMSWSLSTRPRLIRSHKGLTSSGGSGPMVREVSEYQLWGTQSSCHLLLCLAWESWKETAA

SEQ ID NO: 790047 - protein, 106 aa, Homo sapiens
MPTMSHSAREAPSSLKVCSASEVFILSFHPPESSEDLISISQRESHLAMDMMTSALPKPRLISGLSSSTLHSGNKSIRSDAVLHSSDVPGWSWVPRIHLSVNKQGR

SEQ ID NO: 790048 - protein, 334 aa, Homo sapiens
DLGVGGCSLWDDPARFIVVPAAYALALGLGLPANVAALAMFIRSGGRLGQALLLYLFNLALVDEFFTLTLQLWLTYYLGLARRPPATRPGPPTTCPPMRRWSSPRSSACAAAASYAVPGPGRLPAWPGAYGAPRALPAPSPGWRAWPLPAWSTAGQARGWPPPRWPSRPPSCWCSGQREPGAGAQGALWPGPGPCNRRRAPARGQDHGPGVPAGLRPQSGAQPPAAGALGGWGGRQRRPVSRRLHARHPAHPQPGAAEPQQLPGPTHLLLLRAPLPPGLLLGTELPPGEGGAQGAWGLLGLLLESLLASPPVSPPCHPPSGIQGGESSLERPRF

SEQ ID NO: 790049 - protein, 105 aa, Homo sapiens
RYPPPTPRKQGSYFFFFFHTESHSIAQAGVQWCDLGSLQTPPPWFKRFSCLSLPSSWITGMSYEAWQIFVFLVETGFHRVGQAGLKLLISSDPRPRPPEVLGLQA

SEQ ID NO: 790050 - protein, 123 aa, Homo sapiens
AKSPGSGTPAKRNLHAEPKTCGALLPSSRLPPSLRFSVVAAVADKCDVGRRELPLSQAASASPSPALAHSRGRRRIYLQGGRASAGEQERRALCAESARIRPAPAHARARGAAAGREGGGCAA

SEQ ID NO: 790051 - protein, 100 aa, Homo sapiens
KDYFSLRVWHSKYLKENKGHLVFLCSGMKGFHKPGHLASPRGPAGLAVKTVKHFYTAFRVHLPAWLPVLVTPAFSNSDVTEGLIHGTRGIFRTPGQCHTQ

SEQ ID NO: 790052 - protein, 70 aa, Homo sapiens
SDGTRINENPPLTALLHFPKPQSLVLVVFCGSQNSGNTTSHLGPPRPPVIEALVPFWPHCLCGALLEMEK

SEQ ID NO: 790053 - protein, 126 aa, Homo sapiens
AKAESGTPRLKGSTHLGLPKCWDYRCEPLCLADTLQQELRRAARGPAWGPVAAQTHGALWGPLGGGALPHTIFLCSGPRRWWSGLSVPSTCHSKWLPFMGLCPASPQVPPSLQDMPWSVPSLESKI

SEQ ID NO: 790054 - protein, 122 aa, Homo sapiens
TVSSIGAQKKLVGWAHMTGALGWEKHFPVAQWQRRTFSRPVTFNVLAGGEEREEGGMGPEGRVTLKMADALSAFCQALRPHFTCVISPNPPNHPRREKKEHSEKRQLHSFPSILPLGAQDLS

SEQ ID NO: 790055 - protein, 116 aa, Homo sapiens
MYPLTLWKPWSFCPDLAVPQNHNDSRVTLFEGDNFQGCKFDLVDDYPSLPSMGWASKDVGSLKVSSGAWVAYQYPGYRGYQYVLERDRHSGEFCTYGELGTQAHTGQLQSIRRVQH

SEQ ID NO: 790056 - protein, 497 aa, Homo sapiens
PLGGCGWTFTTSYKLKRHLQSHDKLRPFGCPAEGCGKSFTTVYNLKAHMKGHEQENSFKCEVCEESFPTQAKLSAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDALTPSSTLCENSVSELLTPTKAEWNVHPDSDFFGQEGETQFGFPNAAGNHGSQKETDLITVTGSSFLV

SEQ ID NO: 790057 - protein, 497 aa, Homo sapiens; identical to SEQ ID NO: 790056

SEQ ID NO: 790058 - protein, 96 aa, Homo sapiens
SISDVQRPLYARRQERICSMTWVLIAVMMMASDQSTVDLLVSARKRNCRTFGLANSRKSLKPAKYPGSEALLRWGNEHEGREGPAFWVPGAAPDKD

SEQ ID NO: 790059 - protein, 42 aa, Homo sapiens
PLSRDLNESLFLRTQQPALISPTDMKATETGQDSAPGLLDLL

SEQ ID NO: 790060 - protein, 122 aa, Homo sapiens
CVQGGLWPSGGMRQAGGGGAQGKVPNPCLTLSVERKRKPPVPVPVDPQGAGQGPPASQPRMSPAGVVSPVARARSAVKLAGPDSQERPRELVQAGFLSPPLRLLLWVSLGPGTCIAAAGVWV

SEQ ID NO: 790061 - protein, 103 aa, Homo sapiens
VLSYLLSPVMTYHILNGGRARIISLILHMLILGLGERFPDLPKLPQFVNDGGGMGATLNLQLPKTFPLSQAFVECVISGIHFGQLWFLGYCWLPIFLDLNSSN

SEQ ID NO: 790062 - protein, 116 aa, Homo sapiens
FHFLTVTNDAAMNIQSFCVDMFSILLGIRLGLELLGYIHGNFMFNTLRRCQTVFQSGCTIQQFFYILVNTYFCYLSYCSYHSRCDMGAHPEFLFFNGKIYFKIYCYFLEKEDCVKM

SEQ ID NO: 790063 - protein, 221 aa, Homo sapiens
MAADTPGKPSASPMAGAPASASRTPDKPRSAAEHRKSSKPVMEKRRRARINESLAQLKTLILDALRKESSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 790064 - protein, 247 aa, Homo sapiens [sequence omitted]

SEQ ID NO: 790065 - protein, 273 aa, Homo sapiens
MAADTPGKPSASPMAGAPASASRTPDKPRSAAEHRKVGSRPGVSGATGGREGRGTQPVPDPQSSKPVMEKRRRARINESLAQLKTLILDALRKEVSRGRRPETRSLGRSCPGPPAYPRPQSSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 790066 - protein, 86 aa, Homo sapiens
MGIKIVFHHGFNLHFLIMRLNNFFMFIFHSHFCEMPFFCYLSPCPQFCFIRGSYVLWIQMPFVHICCKNLLSVNDLVLLWYISEKN

SEQ ID NO: 790067 - protein, 82 aa, Homo sapiens
KNRGLYRHILLYGPPGTGKTLFAKKLALHSGMDYAIMTGGDVAPMGREGVTAMHKLFDYTEVGRPEPCFQPWPGATEPGRGV

SEQ ID NO: 790068 - protein, 247 aa, Homo sapiens
KNRGLYRHILLYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 790069 - protein, 119 aa, Homo sapiens
KNRGLYRHILLYGPPGTGKTLFAKKLALHSGMDYAIMTGGDVAPMGREGVTAMHKLFDWANTSRRGLLLFVDEADAFLRKRATEKISEDLRATLNAFLYRTGQHSNNPSHVSHGGSSPA

SEQ ID NO: 790070 - protein, 56 aa, Homo sapiens
MGQSLTPWGSACLACSCRGRTLLWAAPGVTLALLGLPLVHSLLLFVDEADAFLRKR

SEQ ID NO: 790071 - protein, 67 aa, Homo sapiens
MTPACELIQTPRKPEIGSRVGWSLRQQFGPSRSLGPRGQTSGSDQSTAGWAWQPAGNLDLAIKLHST

SEQ ID NO: 790072 - protein, 143 aa, Homo sapiens
CSSGLKYSMELDEMDEVKFFSQEKDLDGKIQNAPNSHSAQHVKMGYGAWYLKPKLGKKLRSDEPLIDPKLVLEKPDEPDILDGLYGPIAFKDFILSKGYEMPGIIQRLFARRGWTYDSVKTPIQRAMQVYKYKEDVTDASEED

SEQ ID NO: 790073 - protein, 130 aa, Homo sapiens
HPRSQDLQGFGGIPTPAHRSMRFMTLLFLTALAGALVCAYDPEAASAPGSGNPCHEASAAQKENAGEDPGLARQAPKPRKQRSSLLEKGLDGAKKAVGGLGKLGKDAVEDLESVGKGAVHDVKDVLDSVL

SEQ ID NO: 790074 - protein, 89 aa, Homo sapiens
SRWIKDLNVRHKTIKTLEENLGNTIRDIGMGKDFMSKTPKAMATKARMDKWDLIKLKSFCTAKETTIRVNRQPTEWEKKFLQATYLTKG

SEQ ID NO: 790075 - protein, 107 aa, Homo sapiens
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSC

SEQ ID NO: 790076 - protein, 110 aa, Homo sapiens
MKICAAIPTSRALPEVVRRMPRKRISGLEWLLQQDPGFSLVNTVKAGMIISFPSNNIYSSVCCCQSEIFKYEFSNSKKSSWIQEERHLGKNNVLYSAHDVSPEKVTSALK

SEQ ID NO: 790077 - protein, 82 aa, Homo sapiens
KVPVNMDGMDLGRVLWIHSCCFPGTARGARIAVWLGPRIRKESLLLEGPGAQKGGVARTCGNEAVSAITGEEWRAGSFIVWC

SEQ ID NO: 790078 - protein, 131 aa, Homo sapiens
VDTRAGPGREVRLVLQERTESGLRSPWLEGPFPQLSAESPASNMKAPRPGNCRQSYSQPESLLILHLEPLPSLPMWVLKKNSHSTTGVLQAFETQDSNCHRLAVTYAISKMGYQSLPHGALGDDVQAEAGV

SEQ ID NO: 790079 - protein, 90 aa, Homo sapiens
VVVVGDDSSVPVILEQAVVVVGDDSSVPVILEEAVVVVGDDSYVPVILEQAVVVVGDDSSVPVIPPEDLAVGQDADVEDSDTDGPDPVRV

SEQ ID NO: 790080 - protein, 214 aa, Homo sapiens
PGPVEEMLAEVNATITDIISALVTSTFIIEKQPPQVLKTQTKFAATVRLLVGGKLNVHMNPPQVKATIISEQQAKSLLKNENIRNECSGEILNNCCVMEYHQATGTLSAHFRNMSLKRIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 790081 - protein, 160 aa, Homo sapiens
YGPESLGCPWRTPCRVSVSLQPWLWKATEVMAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFCKPWMKTWTSWKV

SEQ ID NO: 790082 - protein, 137 aa, Homo sapiens
KELERQQRRRFRFHHLFLFPSLRTPAGYNPENLATLERYVETQAKENAYDLEANLAVLKLYQFNPAFFQTTVTAQILLKALTNLPHTDFTLCKCMIDQAHQEERPIRQILYLGDLLETCHFQAFCKPWMKTWTSWKV

SEQ ID NO: 790083 - protein, 166 aa, Homo sapiens
MVPVQPSLLSDHGHRPDPAEGPHQLAAHRLHPVQVHDRPGTSRRTANPTDFVPRGPAGDLPFPGLLQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 790084 - protein, 139 aa, Homo sapiens
YGPESLGCPWRTPCRVSVSLQPWLWKATEVMAMFGADESQHVETQAKENAYDLEANLAVLKLYQFNPAFFQTTVTAQILLKALTNLPHTDFTLCKCMIDQAHQEERPIRQILYLGDLLETCHFQAFCKPWMKTWTSWKV

SEQ ID NO: 790085 - protein, 236 aa, Homo sapiens
YGPESLGCPWRTPCRVSVSLQPWLWKATEVMAMFGADESQHVETQAKENAYDLEANLAVLKLYQFNPAFFQTTVTAQILLKALTNLPHTDFTLCKCMIDQAHQEERPIRQILYLGDLLETCHFQAFWQALEMAGLAQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 790086 - protein, 118 aa, Homo sapiens
KTIQNPVSLDKPGSHQHFPFSIYSNLHRRSSKRIPLCPPFFLHQSTRNAQDSQVIPHPYILSSLYTLYVPTLTPFLFLPQFPKSFRSVFWNSWYTSSLKYPISSVLLLHTLHLTCSQL

SEQ ID NO: 790087 - protein, 76 aa, Homo sapiens
YRKRLQETLYRKSVYSDSRNTRDISYDQESSPMTTRNSATQENSISKRKRKKRQRLGEKHKILIFNKREHTFFSRY

SEQ ID NO: 790088 - protein, 289 aa, Homo sapiens
HERVHEGPRDSRTGENGSCDGAKSELRRALVRAGKWESLGSFWTRRPMAQASRSGSLPPLVIVPPLRAQPGGTGEEQWERSRTGGLRWEVHCWPSGTSGGTPWWPTPADVSEDYEADAAAWRRGPAGGGPIPPALQRLRAVLLRLHREREQLLQARDCAYHLQSAVRLMKTLSPGSPSGGPSPLPQWCRDLQLHPSQGAVLRIGPGETLEPLLLARPIGLAAQCLEAVIEMQLRALGREPASPGLSSQLAELLFALPAYHTLQRKALSHVPGAARPFPTSRVLRLLTGE

SEQ ID NO: 790089 - protein, 63 aa, Homo sapiens
MPPHRPTGAAVTLTPVPGSVDRNSQWAASTPLGALYEWDFLLIRHFKRLSTKRTNSVKYWRDL

SEQ ID NO: 790090 - protein, 87 aa, Homo sapiens
ATHSLCYDFITLSQPSPGKPLTKSQATWMTTLSYDAARRAGGRAPCILGSGQGPKSLGEAGSQTEGQSPAPCHHPGEHHGTQQPEPR

SEQ ID NO: 790091 - protein, 189 aa, Homo sapiens
TAGPAGSLSSSGRRSLFRRMGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRMEEMYKKAHAAIRENPVYEKKPKKEVKKKRWNRPKMSLAQKKDRVAQKKASFLRAQERAAES

SEQ ID NO: 790092 - protein, 316 aa, Homo sapiens
TAGPAGSLSSSGRRSLFRRMGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKKAHAAIRENPVYEKKPKKEVKKKRWNRPKMSLAQKKDRVAQKKASFLRAQERAAES

SEQ ID NO: 790093 - protein, 174 aa, Homo sapiens
MRALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 790094 - protein, 169 aa, Homo sapiens
HKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCELLPFAHCFVCPKPYSHH

SEQ ID NO: 790095 - protein, 235 aa, Homo sapiens
HKQAMQGFKLYMPRGRYWRLRLCPEPPSAPSEYAGLVVRTVLEPVLQGLQGLPPQAQAPALGQALTAIVGAWLDHILTHGIRFSLQGALQLKQDFGVVRELLEEEQWSLSPDLRQTLLMLSIFQQLDGALLCLLQQPLPKSQVHRRPPCCCACQEVQTTKLPSSCLNSLESLEPPLQPGTSPAQTGQLQSTLGGRGPSPEGYLVGNQQAWLALRQHQRPRWHLPFFSCLGTSPES

SEQ ID NO: 790096 - protein, 72 aa, Homo sapiens
SGGDDDSDSDAAVDCGGGDDVIRAASTTTKYFSSFTKFNTCSDTSILQMRTPRLREVLGHLKATQLESHGSG

SEQ ID NO: 790097 - protein, 111 aa, Homo sapiens
GLSLPEIAPTLQSPFHLSCSAPTHSSLHLLVNFLYLHLNRDSQSSDHSSYAQSFNFSTYYNPPYPAQSPWTMSLILPFHIPSTPWNFSLFTTLGWQSPTWVKTCLLLPRAC

SEQ ID NO: 790098 - protein, 130 aa, Homo sapiens
RGSSAGTPWEMGGAAGEAPPQKAALAWTPAQAPLDVLPSFGGSGRRLRPAPYAPGSAEGHMPVPPSSWLPGSISVPRVFIQVQEKVVSDDKAGEEVSGFKVPEGLSLGKADHSLSSIGVKETHQMLGKTG

SEQ ID NO: 790099 - protein, 229 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFPG

SEQ ID NO: 790100 - protein, 105 aa, Homo sapiens
MWRGTEAPCQLPVQTCQPCKAATRAADPAAPSSDCSPSHQLDGNLTRDPELGPPSPAASESLTHRNCEIINVFCSQVRWLTSQHFGRPRQPDHKVKRSRPSWPTW

SEQ ID NO: 790101 - protein, 104 aa, Homo sapiens
LQRNTQKGSRKISNKIRTNGDSNIREENVSRDSYIQLGLMLQTSKTVALILQPCWWPWEQPCLRICEHRGQAAAGFGISLKVRRVDTSFGKFGCNFWSSLYVGR

SEQ ID NO: 790102 - protein, 136 aa, Homo sapiens
SCRCWDPPGWACVSVCALQTGVQLGPEVMHPLGRREAALPGRRTWRPLCTPGPPPPTFPGHQEPQTRSGLAGEPWRPRIFLSSGLHWPPLTWPAAPCSHSKLLHCSAGPRVPGRGPWAAPLHCQPCSPHSAPPWGL

SEQ ID NO: 790103 - protein, 150 aa, Homo sapiens
PGSSNCLASASRVAGITGARLYIWLIFFEFFLVETGFLHVGQAGLELPTSGDPPASASQSAGIIEVRPCVGSGLGEACPTFTAWLCLVATAAVLGHRGPPASSFLVCADFNTVGYSRGTGSATSHTSGEVAAEESLPQGRGRPQDIWVPD

SEQ ID NO: 790104 - protein, 195 aa, Homo sapiens [sequence omitted]

SEQ ID NO: 790105 - protein, 120 aa, Homo sapiens
HKGFSTFLPTLVIFCLSFYFFKHAPLSMQMLRRSGAKLALFLISQRPDDLLVRLYLLHISLRSTTQKTQGLNTKRKTTVDLCWKEPFSQQSKMSNNTQVPFLQLFFLFLVQEHLHYMIIL

SEQ ID NO: 790106 - protein, 108 aa, Homo sapiens
VVSLFLRPGLCLGGCWRNSLGVQCCHCWIHGKLCLSPLGLVKFAVATKDLSGQPKPAVPVSVFSLAIAFSLLDPASSYMLWSSERCFLNCNIFLVGFMGSSASLHLGW

SEQ ID NO: 790107 - protein, 123 aa, Homo sapiens
GVRVRGRSCRRQPELRAAAAEDGCGRGGGHSADAWSRADRDHLSTVEKDTNGEVLWVWCYPSTTATLRNLLLRKCCLTDENKLLHPFVFGQYRRTWFYITTIEVPDSSILKDSFFYCPDRQRF

SEQ ID NO: 790108 - protein, 247 aa, Homo sapiens
GVRVRGRSCRRQPELRAAAAEDGCGRGGGHSADAWSRADRDHLSTVEKDTNGEVLWVWCYPSTTATLRNLLLRKCCLTDENKLLHPFVFGQYRRTWFYITTIEVPDSSILKMYLKHGSPVKMMESYIAVLTKGICQSEENGSFLSKDFDARKAYLAGSIKDIVSQFGMETVILHTALMLKKRIVVYHPKIEAVQEFTRTLPALVWHRQDWTILHSYVHLNADELEALQMCTGYVAGFVDLEVTRPTL

SEQ ID NO: 790109 - protein, 72 aa, Homo sapiens
GVRVRGRSCRRQPELRAAAAEDGCGRGGGHSADAWSRADRSHQGPRGRGKRLTPTSRRSKWRPRPSLCTDTP

SEQ ID NO: 790110 - protein, 72 aa, Homo sapiens; identical to SEQ ID NO: 790109

SEQ ID NO: 790111 - protein, 116 aa, Homo sapiens
GFGCEAGPAGGSQSCAPRRRKMAAAEVADTQLMLGVGLIEKDTNGEVLWVWCYPSTTATLRNLLLRKCCLTDENKLLHPFVFGQYRRTWFYITTIEVPDSSILKDSFFYCPDRQRF

SEQ ID NO: 790112 - protein, 79 aa, Homo sapiens
LHRGSGERTASEAAAWDEPLAIPLTSSVTSDKLLKVSGLQFCHLSRRKSSSPCVMKIQGETHGLTLNNMDTEQNLNLWF

SEQ ID NO: 790113 - protein, 144 aa, Homo sapiens
GAVKAVAWCPWKSNVPATGGGTSDRHICIWNVCSGACLSAVDALSQVCSTLWSPHYKELISGHGFAQNQLVIWKYPTMAKVAELKGHTSRVLTLTMSPDGATVASAAADETPRLWHCFELDPVWRREREKASAAKSSFIHQGIR

SEQ ID NO: 790114 - protein, 78 aa, Homo sapiens
VGSCQAPKTPRPSTQSHGGSTASGRPATLGLRVSPSAPAQPNPSATHLVTPNCSKTTLPVTQQLLKFKSLEQFTVIRP

SEQ ID NO: 790115 - protein, 108 aa, Homo sapiens
TVSPLPSSMDLLIQDSPDSSTSPKGKQPTSAENSVAKKEDKVPVKKQKTRTVFSSTQLCVLNDRFQRQKYLSLQQMQELSNILNLSYKQVGLFCPCNKVNKNWTNLHG

SEQ ID NO: 790116 - protein, 143 aa, Homo sapiens
GESSHEFQAYKTTALELRGGSRRAPGRRGHSWVVGRASSVSCKGCLALPARGAGGWDGGFNIKRRKSQIFLPSMPSSPPLPPPTHTLSLDAQRITYLPGRDPFPPHTPQLGPSYGDAARVGDYETRNGTLSPLIRLQTLIRPA

SEQ ID NO: 790117 - protein, 103 aa, Homo sapiens
MLASFSSLADRVLPIWWVEPYSWTSNFCTHQGSGTEKGPEYRHLNKPSSYSLSQTPISRTFQLTYKQKSILIVFEINPYCVLYCGDYLLYSVSMAIANKYMSP

SEQ ID NO: 790118 - protein, 70 aa, Homo sapiens
FSVLLPPALSIVTVDPSLSSMLPPACCDLTLFCCPGTSWASSRVPFLLLILCLAVWLLELSPGLRRMTNK

SEQ ID NO: 790119 - protein, 173 aa, Homo sapiens
MPGCRISACGPGAQEGTAEQRSPPPPRDPMPSSQPPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGP

SEQ ID NO: 790120 - protein, 160 aa, Homo sapiens
MPGCRISACGPGAQEGTAEQRSPPPTPTLTPTPTPGQSPPLPDAAGASAGAAEDQELQRWRQGASGIAGLAGPGGGSGAAAGAGGRALELAEARRRLLEVEGRRRLVSELESRVLQLHRVFLAAELRLAHRAESLSRLSGGVAQAELYLAAHGSRLKKGP

SEQ ID NO: 790121 - protein, 104 aa, Homo sapiens
VQTITARLHVEIYIWTGPSFSLQSRKKRATHSFHPYAANCCCCCCFLPLRLLYDTDRCLKAFRPERTVGKIAAKGLTNDDLSVRKVLISCAKWTKRIKERRKIH

SEQ ID NO: 790122 - protein, 95 aa, Homo sapiens
MRGPVGTEEELPRLFAEEMENEDEMSEEEDGGLEAFDDFFPVEPVSLPKKKKPKKLKENKCKGKRKKKEGSNDELSENEEDLEEKSESEGSDYSP

SEQ ID NO: 790123 - protein, 139 aa, Homo sapiens
EIKSLTSRLDVVARQDFGRPKQVDHLRSGVQDQPGQHGETPSLLKIQKSAGREYMALGDRRPGGYMQRFQQQPQQGWKVANSLKHSRQLASFAKPAQEPLTRGSRSHLLGRGEEREERVLTELNINPELIMLNTKCLSI

SEQ ID NO: 790124 - protein, 109 aa, Homo sapiens
LLASCVHWGVLSPLEFCLLAANQESATQTMQPPGPLLFPCSMTWGPPPCSTHLHKHVFTMGVLSLNRPFLLLVGAREFLPMETQSKTTLKNTDPCERGHLLSPCPLADK

SEQ ID NO: 790125 - protein, 108 aa, Homo sapiens
GSGPEERCACGVCRRSVGVRAHFLPSPSAARFIYMFISLQRHIHFYSLCFQVYLYTSAQTHQISWDAHTRVDYRPPSPSQKAQISMRVGKARKRCGDSVGHRSSPALS

SEQ ID NO: 790126 - protein, 67 aa, Homo sapiens
NKSGVLEQLIWMVWLRASRETVVKLTVGAVVIWRLNGLTDPLSTRLLHLVAGRRPQFLLCGPPLGAA

SEQ ID NO: 790127 - protein, 112 aa, Homo sapiens
MCAPFLSSRRFQAGTQPASSLHGWPSSLPPNRGSKKSHGCLSRSRSPSPQSARHNVTGKCEGETSSPQESSSLAGMQALLKAVADQVLKGCSIWPMYILSHSFCNKEGGKGQ

SEQ ID NO: 790128 - protein, 122 aa, Homo sapiens
CQNATSTQDCDVYARLDLSEMELGSEARLKGRSGGSGYAGKGLGSFQYRLGWEAAVRRSVSVRTLEWDLGRAGSWELGTRRAGWGCSVLGAGNEEGWLGLPLSRGWQARGRVDVYLLGCGVS

SEQ ID NO: 790129 - protein, 132 aa, Homo sapiens
SAVMLLGGWLLLAFNAIFLLSWAVAPKGLCPRRSSVPMPGVQAVAATAMIVGLLIFPIGLASPFIKEVCEASSMYYGGKCRLGWGYMTAILNAVLASLLPIISWPHTTKVQGRTIIFSSATERIIFVPEMNK

SEQ ID NO: 790130 - protein, 107 aa, Homo sapiens
ETESWSVTRLECSGTISTYRAPGSSDSLASASQVAGTTGTHHHAQLIFLFSVEMGFHHVGQAGLKLTSGDPPALASQSAGIASVSHHTRPFFNQLVECACGLSYLAD

SEQ ID NO: 790131 - protein, 36 aa, Homo sapiens
LELRVLLSRTDNESQSCSDGEIQKCLFALSPPSVVF

SEQ ID NO: 790132 - protein, 68 aa, Homo sapiens
GERGNITPKLTATEGMRICIRRGSERLTLLPTRTVERGPEVRDTVTGVLEVKKLRVSFEINSTGQWLK

SEQ ID NO: 790133 - protein, 1007 aa, Homo sapiens
MKDEAGERDREVSSLNSKLLSLQLDIKNLHDVCKRQRKTLQDNQLCMEEAMNSSHDKKQAQALAFEESEVEFGSSKQCHLRQLQQLKKKLLVLQQELEFHTEELQTSYYSLRQYQSILEKQTSDLVLLHHHCKLKEDEVILYEEEMGNHNENTGEKLHLAQEQLALAGDKIASLERSLNLYRDKYQSSLSNIELLECQVKMLQGELGGIMGQEPENKGDHSKVRIYTSPCMIQEHQETQKRLSEVWQKVSQQDDLIQELRNKLACSNALVLEREKALIKLQADFASCTATHRYPPSSSEECEDIKKILKHLQEQKDSQCLHVEEYQNLVKDLRVELEAVSEQKRNIMKDMMKLELDLHGLREETSAHIERKDKDITILQCRLQELQLEFTETQKLTLKKDKFLQEKDEMLQELEKKLTQVQNSLLKKEKELEKQQCMATELEMTVKEAKQDKSKEAECKALQAEVQKLKNSLEEAKQQERLAAQQAAQCKEEAALAGCHLEDTQRKLQKGLLLDKQKADTIQELQRELQMLQKESSMAEKEQTSNRKRVEELSLELSEALRKLENSDKEKRQLQKTVAEQDMKMNDMLDRIKHQHREQGSIKCKLEEDLQEATKLLEDKREQLKKSKEHEKLMEGELEALRQEFKKKDKTLKENSRKLEEENENLRAELQCCSTQLESSLNKYNTSQQVIQDLNKEIALQKESLMSLQAQLDKALQKEKHYLQTTITKEAYDALSRKSAACQDDLTQALEKLNHVTSETKSLQQSLTQTQEKKAQLEEEIIAYEERMKKLNTELRKLRGFHQESELEVHAFDKKLEEMSCQVLQWQKQHQNDLKMLAAKEEQLREFQEEMAALKENLLEDDKEPCCLPQWSVPKDTCRLYRGNDQIMTNLEQWAKQQKVANEKLGNQLREQVNYIAKLSGEKDHLHSVMVHLQQENKKLKKEIEEKKMKAENTRLCTKALGPSRTESTQREKVCGTLGWKGLPQDMGQRMDLTKYIGMPHCPGSSYC

SEQ ID NO: 790134 - protein, 236 aa, Homo sapiens
LFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALNNNKAWDYLCWRFRKTLTDLP

SEQ ID NO: 790135 - protein, 143 aa, Homo sapiens
SNPPRGRLAVGSCPYPVQTRVWLESPGPPLDRVLIQGWRFISGQGQGGGTLPVCLEDTHMASFDSSCRSPWHHFLRHRTQPPPTGKAPALCPDSPSCAWLPHLCLAPPETPVPAQCAVCSLCHLLGWSDGSMRAGRLSTLFTV

SEQ ID NO: 790136 - protein, 368 aa, Homo sapiens
MPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 790137 - protein, 442 aa, Homo sapiens
MAAATLRDPAQQGYVTFEDVAVYFSQEEWRLLDDAQRLLYRNVMLENFTLLASLGLASSKTHEITQLESWEEPFMPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 790138 - protein, 134 aa, Homo sapiens
ISHTGGSPALRQVGGRNGRSLAGGLKPKGPRRRVPASFQPRPPGRNPLPTGPWAPPARRCPGAPRHMLPAGRAARRSAHCRGGSQPIKSPGFLQPYGPRGEQQCPGPFTSKAAIRGKAPPENFFFPSAFHSWFE

SEQ ID NO: 790139 - protein, 139 aa, Homo sapiens
ALPIAQGHPPLAGAGPSTTPSFHPLWSRAPSSQQRKVHPSACSLLPLSGVLVPVCSPWTPSPDSSRCQPWVQPGACPRLPVGRAAMASRVPRTLGNGGGGCWRGLACACRVGWGKEGRPQPVWGPLRAECVGASESRVC

SEQ ID NO: 790140 - protein, 101 aa, Homo sapiens
LHLQPSSCSARSCFGELAAGAQQLGEFCLQCFPKRPVGHLGLPWWWGFWPQQQGSGGRNDSNPVKREGQKGQRSQCKSTVWESESTQIVPSGNMACAWCDS

SEQ ID NO: 790141 - protein, 133 aa, Homo sapiens
PNSETDNVVQKEANGLTPGISGTGCIVCAYLTSFQSWSLLASTISLLVQAKTSCCLSESILCLFCFVFVCLFVCLFLTVSCSVTHTGVQWCNLSSLHPPPPRFKLFFCLSLPSSWDYRHAPPCPANFFVFLVE

SEQ ID NO: 790142 - protein, 131 aa, Homo sapiens
SRSYKELVLISGDLSAQGSCSARSSPGQHHTETSLCKHGAPCRRAGGFLVLENSSLKPLCWRTAWPGGGCVAQQFLLLANSQQSDPLTSQHSHASKSSTVFPWKLLEGLSSFPLRKLFLAVIHIPVALFSS

SEQ ID NO: 790143 - protein, 115 aa, Homo sapiens
GSAWHLNPVPSAPRPSQWRLRFSLQRQSCHRGHWEVACSVSTDRRSPTTRHGGFLGSSPPRTAIRSGDSDTGQQQRFPPGRQPDAHTHADHTIQKVHLRPETQLFEGDQKIRWYL

SEQ ID NO: 790144 - protein, 153 aa, Homo sapiens
TDLRRQALPQQPCKGQDTEGPSQGAALREATIPGLSQTLGAPGEATGAQVLAPPHSEASPGRGLQRPCRVPGRKAWGPPSGHPYQVKGHGPLGALLVQPLGSSRSMALSLHRPSSRRGPHHIMSHQACHVVPPPAIPHHQPLPEQGPALPRVL

SEQ ID NO: 790145 - protein, 126 aa, Homo sapiens
SSRAEPHSLRDCLEVCFSMPSSFERAVACPTSKSPGAPVSRQGFTGHLQRETGANPRQRPCDYAWPWPIPQQLVLTCVTGGIRGDGETKGVVQACAGGRGKQVTFPSMPRKIENTWDPRGVGGACD

SEQ ID NO: 790146 - protein, 103 aa, Homo sapiens
ARLPICKKQPLCRNRPLPGWPVKKQSKATRSSAAWLPGSVVLAVKLPDSHCLLCVVRRTWTSVLCAHKTVLGGWARGPRFASVPEVSFPFQEGGSVDPLSVTT

SEQ ID NO: 790147 - protein, 59 aa, Homo sapiens
MPRSPCSSDTSGGWAEDGQDQDGKASTRTQGGEVSRASEVTGIRGHREESRSTGQCRES

SEQ ID NO: 790148 - protein, 117 aa, Homo sapiens
MPSTVLPSTVLPSLLPTAGAGWSMRWILCWSLTLCLMAQTALGALHTKRPQVVTKYGTLQGKQMHVGKTPIQVFLGVPFSRPPLGILRFAPPEPPEPWKGIRDATTYPPGKESEACP

SEQ ID NO: 790149 - protein, 150 aa, Homo sapiens
ENAAASPRGLTGASTLLGGNPGGPQFPSQQLLANLCAKQRATLQDHEARQPRRLLQGVLSGVTPELSRFPGPLDIACASNSEIDGVSGMRRSPASSPPGGEPRGLGPERRQPGCSPPGELPSPAGDSGEPADCEAEEGSAWFSYPLLSSG

SEQ ID NO: 790150 - protein, 75 aa, Homo sapiens [sequence omitted]

SEQ ID NO: 790151 - protein, 75 aa, Homo sapiens
MPGLVTEEGAVLMHTGLSQRWPVFQGARCGMEQRTPFTPASNAPLPDANATTDRTLQGQGCQQKLGLAPRSHASS

SEQ ID NO: 790152 - protein, 51 aa, Homo sapiens
MNCGDTLEASTPSPFSGFPPQPGHGRLKSCQFLFLGLWVLVERLTPPRKHF

SEQ ID NO: 790153 - protein, 35 aa, Homo sapiens
MGPSSHWAVQRDCVSGASRARWLSVNASQIKGLWL

SEQ ID NO: 790154 - protein, 70 aa, Homo sapiens
IKISKSLVKLTKKEMIQITNVRNEIKDITTDFMDTKRIMKEYYEQFYAHKLENLDEIGQFLERYHLPKLI

SEQ ID NO: 790155 - protein, 105 aa, Homo sapiens
VWQKNWEVEGVPLVGPELWFQLGEVTPALLPLPASPPLSLSQSFCLGKQQTFPGLSSEWCSVGISSKESRGVSALGFLYCAFRNPMEAMYPHIFYFHFKNLRKAY

SEQ ID NO: 790156 - protein, 129 aa, Homo sapiens
FKKACTRLGEFAVCTSAPSDLGCAPQLGTPGAHSRTSGWRHIKAAPSLCRLAPEMLSDLLMVPPPVNCSDLHFSFEKTETQKIKIFECYLAEGELLFITTAWEFPAGFLHSLGKKNSPKSILRTAQRRS

SEQ ID NO: 790157 - protein, 129 aa, Homo sapiens; identical to SEQ ID NO: 790156

SEQ ID NO: 790158 - protein, 124 aa, Homo sapiens
LHRRVGFVPGLFRDPFSAILLASPSFSFQYCLYIGFPHGGKMIAAVSGIIPSPPIWLKGHIPFRLGNDLLEVYTVFRVVPVAPHALAFEVKAAERLAFYSFSLLGGEVALLITPVRMINSLKKK

SEQ ID NO: 790159 - protein, 67 aa, Homo sapiens
ENFQKGTIGLELEARLLGFEERRGGGGCVLHEDVFTDSNLLWSGQRARRRCQLPSDVSSSYHGCVKL

SEQ ID NO: 790160 - protein, 67 aa, Homo sapiens; identical to SEQ ID NO: 790159

SEQ ID NO: 790161 - protein, 40 aa, Homo sapiens
MMTATYLPLKKDSTHNSTCNFRELMEPLMPKDLRRKCSVR

SEQ ID NO: 790162 - protein, 203 aa, Homo sapiens
MRLGTRHGCCSDTILSALGPLLPREEEVKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLGSTTCIGGSSLIERIDSLARLEVMSVKSPQAPLWVSHGT

SEQ ID NO: 790163 - protein, 218 aa, Homo sapiens
MRLGTRHGCCSDTILSALGPLLPREEEVKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVSCCRTNHR

SEQ ID NO: 790164 - protein, 47 aa, Homo sapiens
MRKPILCSENKAILPLDVILCRRYSAGCLWYYYKKLDISIFKYHLRK

SEQ ID NO: 790165 - protein, 75 aa, Homo sapiens
PNPLGWKRRKWRVWGRRRPSRGQVSTASCPAEGVQVLGIMNKELDKMHKATEEGSSKGRDVWNMNAHSTVQWEPG

SEQ ID NO: 790166 - protein, 293 aa, Homo sapiens
AEPVTTLPPGPGDDALHQPPLSSTMVVLRGPRRCRHCPRRCHYPLRAPGKPTAFPLLPAPALPALGPLSPVRRYHHPSCEAAINTHISLELHASYVYLSMAFYFDQDDAALEHFDRYFLRQSQEKREHAQELMSLQNLRGGRICLHDIRKPEGQGWESGLKAMECTFHLEKNINQSLLELHQLARENGDPQLCDFLENDFLNQQAKTIKELGGYLSNLHKMGAPEAGLAEYLFNKLTLGRSQKHTRAQTGPTATGCLPLLAPPGGTSMFPFQNILFIFLLSVLPLLAIKLSVL

SEQ ID NO: 790167 - protein, 125 aa, Homo sapiens
PLDYIAATQWTQPSQGQVPHSVDIPRKITLEPVSPPGRACLAPSPLPRPHQLTSHAAVPRHHHSLAVNHPQPHFRSAGSAGSRITVESAAQQVGSPGFRPHRSLVGGILSGNCFKFYFLPLKKMK

SEQ ID NO: 790168 - protein, 143 aa, Homo sapiens
MDWANVPPLLESGDLGGKGRTGWLEEPPPCKGPGGRLRRRQAQSSNMHLPQLQGRSGACQFTPPHDLMAVCARHWLREQHLTEKILGWATGQNWAKTLERGTWLKATPHFHVIFQWHQLSWTDVLTELHMPQSSLVARVSSVH

SEQ ID NO: 790169 - protein, 114 aa, Homo sapiens
LLPPRPCPCHGSRLANTAFIGCLPVELPLHSSVSRTFQVNSPGRIPAKTVLKGPFKQSIPSIGLPWFLSTRAAYPPLSDGYRGWCEAGRLPFLGRTSGCVAPSTLSSWPARQQD

SEQ ID NO: 790170 - protein, 131 aa, Homo sapiens
CEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRS

SEQ ID NO: 790171 - protein, 123 aa, Homo sapiens
LHQGSDLPQVTRQVGARVHAPDSAGDLCTHFPLWVPAPHVQRWGTEGEATLSLFIPACEQAPGLWRPAGRVTASHLHPSPFSFYKERRKTGSSWGDPGRRQRPPQGGVGERTGTYQPRATGAR

SEQ ID NO: 790172 - protein, 68 aa, Homo sapiens
LPSNHYRREDDDDNDDADDNDGLCATLCWPSQRLYQESPTAWDFCSWKQLRLWQEALPQGNSISPVCL

SEQ ID NO: 790173 - protein, 82 aa, Homo sapiens
AGEREEDQRLSPVTLHLQSCRKEEKPERETEKEERMEREENQESEESWKTGEESVQGHSMVFYCQMLLLGQITIDLLPLKSQ

SEQ ID NO: 790174 - protein, 72 aa, Homo sapiens
PCGSRYPGRMRGLLDVAICHPWVAGHKDEAVAATVTRWPLKVELTGKGPRLPQRYRRCPAGVVASRGKPGST

SEQ ID NO: 790175 - protein, 160 aa, Homo sapiens
SWVAEDFHQAGPGRRKGPQSPQEGRAGLGKKKKKSYHLHVCSVKFKRDFKNVHVSFPGFSLGTHVSFLLSPTQFCGAWEALQQSLGPDWSPGEGRPRSPRSFPSRGFALSSAVPSRSPPGSRVGRRERLGAALAREWLTPDVAPLEAVARPPWRQLPRPG

SEQ ID NO: 790176 - protein, 115 aa, Homo sapiens
MTMTQHIIFSDFKAINLVFKFNHSRFSFVSLLFLPFLKVNLNFQRTYILCCNQKKGLCLSYSVADHSKTFYCHHEAGITAESMLSLWSLVVKFIHSKSYSFQPQVSLGPSIFCRL

SEQ ID NO: 790177 - protein, 31 aa, Homo sapiens
MNPMGVTHHLLTMRKLPPQLPQEEKAQSCRS

SEQ ID NO: 790178 - protein, 77 aa, Homo sapiens
LPACPDFRKERRSFASSVAGSALQCLMFTEILIVVSLPQDFIVWKMPSPSNLSSRPGSPKVTNFNGALKLNRNHPSH

SEQ ID NO: 790179 - protein, 119 aa, Homo sapiens
TIISVGCRLIFFSFETESRSIPQARVYGVILAHCNLHLLGSSDSPASGSPATGTTAACHHARLVFLFLVKMGFHHVGQAGLELLISGDLPTSASQNAGITGMSHHAQTGTILMLSIKLG

SEQ ID NO: 790180 - protein, 60 aa, Homo sapiens
MDRGAVVGLDLRMTFNCQDLVTNRMSGTERKAQVGKTQGFQCGRLLHSAGPHRVLGKGPI

SEQ ID NO: 790181 - protein, 111 aa, Homo sapiens
SSLSLEVIERLLQAWWEKSQFDRRWRDKREDLSDVAQTGSDLLKRQPWAAGKRSCQETQCRCQQDQKISFLERVPPGRGKPREGAQQRAKLGGGGSTQTEGRATLATSSEY

SEQ ID NO: 790182 - protein, 112 aa, Homo sapiens
RNWSSCHFSAFQGKLSQVHRTESLTGIFKGSGFSPTCLFQIMGNWALRQTQSPLSASLRISVPSRFSQLHTLVCNGRVYVGSRYILSSSCLWQLSGVTYEYAVKLRCLRLCA

SEQ ID NO: 790183 - protein, 154 aa, Homo sapiens
QPGERVDLQTTQQALAVSSMRNRRDIHGTSCRKEEEEKSYLLGPYPGKFPTLVLFTGCCPERQILSSPSHERGNQGCKQESDSAKVTQLESGRDGTQHDISLQSWQLLRALPLLNRDLPGMTRRPSGFSGLVLRTFIRFFSKYLLSATVCQALF

SEQ ID NO: 790184 - protein, 454 aa, Homo sapiens
MLKQILSEMYIDPDLLAELSEEQKQILFFKMREEQIRRWKEREAAMERKESLPVKPRPKKENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRSLSSSSRNIQQMLADSINRMKAYAFHQKKESMKKKQDEEINQIEEERTKQICKSWKEDSEWQASLRKSKAADEKRRSLAKQAREDYKRLSLGAQKGRGGERLQSPLRVPQKPERPPLPPKPQFLNSGAYPQKPLRNQGVVRTLSSSAQEDIIRWFKEEQLPLRAGYQKTSDTIAPWFHGILTLKKANELLLSTGMPGSFLIRVSERIKGYALSYLSEDGCKHFLIDASADAYSFLGVDQLQHATLADLVEYHKEEPITSLGKELLLYPCGQQDQLPDYLELFE

SEQ ID NO: 790185 - protein, 454 aa, Homo sapiens; identical to SEQ ID NO: 790184

SEQ ID NO: 790186 - protein, 454 aa, Homo sapiens; identical to SEQ ID NO: 790184

SEQ ID NO: 790187 - protein, 454 aa, Homo sapiens; identical to SEQ ID NO: 790184

SEQ ID NO: 790188 - protein, 427 aa, Homo sapiens
MLKQILSEMYIDPDLLAELSEEQKQILFFKMREEQIRRWKEREAAMERKESLPVKPRPKKENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRKKESMKKKQDEEINQIEEERTKQICKSWKEDSEWQASLRKSKAADEKRRSLAKQAREDYKRLSLGAQKGRGGERLQSPLRVPQKPERPPLPPKPQFLNSGAYPQKPLRNQGVVRTLSSSAQEDIIRWFKEEQLPLRAGYQKTSDTIAPWFHGILTLKKANELLLSTGMPGSFLIRVSERIKGYALSYLSEDGCKHFLIDASADAYSFLGVDQLQHATLADLVEYHKEEPITSLGKELLLYPCGQQDQLPDYLELFE

SEQ ID NO: 790189 - protein, 241 aa, Homo sapiens
MLKQILSEMYIDPDLLAELSEEQKQILFFKMREEQIRRWKEREAAMERKESLPVKPRPKKENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRKKESMKKKQDEEINQIEEERVLVIDTNAVGRRPGDKRQVGVMQPEGKGHQGSPATSRSQQRGMGQVPHKP

SEQ ID NO: 790190 - protein, 104 aa, Homo sapiens
MCQPVLGTEDTGGKARIAPCSPGAHHPGGRHSRQPELVQRRHLSRFRIQSLFKKIKEPDAPARDRARSGSRVHPETLHPKGKGRPSLLGTRTHLLPVGLSLSPK

SEQ ID NO: 790191 - protein, 110 aa, Homo sapiens
GCGRGRTGPGLRVSRGWLPYFLWSQPEAGTPTQQPCDTLMSHLHIFAENPQGREGPIYSGRNLLGPNPATSQDWMAQPRDEHVSGFHGQWERLHPAHVLLWLSGQTDGWG

SEQ ID NO: 790192 - protein, 116 aa, Homo sapiens
GGKRDQEELWAHRQSLCFSLEEGCPEMQKGFPEEVGEDCTQQILYSLPRITDLRPDFSVSSQDHAFCRPQPMGVGGWGVGPSIVHGTFGGPQMQGSVASLLDPRSQAAAELKETVQ

SEQ ID NO: 790193 - protein, 180 aa, Homo sapiens
MERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 790194 - protein, 86 aa, Homo sapiens
EFPCPDKPGSATRAQGLFHPLSTTVKDSRPQSGQVEKDYGKIWVEAWGPSCGNIPLGDDSDPDRVHGGGERWSEPGYMLKSVSRIS

SEQ ID NO: 790195 - protein, 105 aa, Homo sapiens
MSERLRGFGLVKETQTETCGNFQELTTLSAGIQVYSMLLQRPKVRITCRITRRQMRFHIKKKINRSRYLEMRWSTLCSHRLSPRVFKGKPVASCPVRTGADGAWN

SEQ ID NO: 790196 - protein, 135 aa, Homo sapiens
VSLPLASPYEISSVVITAHLATLWRGRKLSFAPTKANTFPGQAMHYRVSSPALGPINNQVGAPGRSPEPSPALAGSRVPGPAHPSRGPRCAQPGRDEPPRSVFAVNSASPPDLALNPDTLGGAKRPPGARPAPRR

SEQ ID NO: 790197 - protein, 79 aa, Homo sapiens
SCSGGGSENWITGYGGDWDNSTATDRNTEGRGSLDLQGLQLTPMGTLDGQRHSPRLGDESIPLTARQGTQGSAAEKLEL

SEQ ID NO: 790198 - protein, 78 aa, Homo sapiens
TKYGSQESAGINPSLTPDSTAQSCKRDFFLLLEEKRGKSREDFVLHLGYWLSHNKVSLQRCMNHSIPGLGVPPKAETA

SEQ ID NO: 790199 - protein, 99 aa, Homo sapiens
TLAGHATTRHQNTGAILAALLSLSLCIQPPGPVGPTTWTLSDTCPSAFLLPLPMCKHSSLFCFIATVAQQLFLPTFSPSPSSLFYSIARVTWLEKEPQM

SEQ ID NO: 790200 - protein, 146 aa, Homo sapiens
QGAECEETRDTAALAPHARLSGGCAPAVLGRMEPVLYETVVENYKQATRGGGLELQSGGCGPRYTVSTRPVRLAWQPELTIVRPRPLDALGDCWAHTGVILSKVTVKSGWVASPCKVAPLCQHSLMASCFRKHPELQLAIELLHIN

SEQ ID NO: 790201 - protein, 76 aa, Homo sapiens
PRYQPRRLEGQPSSNHWASHRSVALLLTLALLFVPGVLFKTKLLEEFGGNYDCNHVFKQLTLEREWTKLNINHCCW

SEQ ID NO: 790202 - protein, 111 aa, Homo sapiens
KKWGALWLPTPHPCSPTPPQPCAKGRAEPPPRRPRPWGDSELMQGECSQVGVSKRRARRWGGCQARGSACPRPRVLSRQRAEAGEAAPGPADPDMPSAWCLVVFEGLGRRP

SEQ ID NO: 790203 - protein, 172 aa, Homo sapiens
ERMQSRQRSCFPTPGFDSPTSPPPGKRALGWHRGTRARLLSSFLSFLNGSSANQAVGQGPEAGEGRGEGCLQLGEKNGRPQSFPVCASLGICESDRSGGNGGAFSVAEISGAPRQGLLENRGDRKLSRGIRRGSPAPRSVTGTYFSFFNSLFLPFSLCLTCFIKKKEVIKLL

SEQ ID NO: 790204 - protein, 95 aa, Homo sapiens
PEICFLIQEQHLKPESRLENQGLPSRSDRLGGGQYPDGVASYTANLKTGHRAHLLPGGQPHAEIHPADRFLDFADRWEGSIDVDSKPFNKSDFDV

SEQ ID NO: 790205 - protein, 168 aa, Homo sapiens
RRGRSRRKGAAAATAASARSQGRAAAMSYCRQEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 790206 - protein, 155 aa, Homo sapiens
MPVSYSSVTTRYYHRAGAEEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 790207 - protein, 168 aa, Homo sapiens; identical to SEQ ID NO: 790205

SEQ ID NO: 790208 - protein, 106 aa, Homo sapiens
AGFLLLSDPSLLLARLRIFSVPVLLEFHYDVTYGTFLSCFQLLILIQFQTHRVIARIVQGALTRAFRTHCLLPSAPLPPPRPVHVQLLRVKQRRRAPGPSTLVYIS

SEQ ID NO: 790209 - protein, 130 aa, Homo sapiens
WVRVLQKELWLNSKIFPYAWCVSPLCIAIKEYLRLGNLFYKMFIWLSVLQSVQEVHCPASASGEASGNLQPWQKVKGEPACHVARAGARVQEGRWPHAFKQPPPTRTHSLLRGRQYQGDGAKPFMRNFPP

SEQ ID NO: 790210 - protein, 108 aa, Homo sapiens
GSSQSLELQLEFTTLGWHMEVRRTDRQLNRQPQGLRQESPSAGTFSNSLKTDSAQAVSAFTEVGLGGGWLREAGEGHQVPQLLMASHRDKAWGPFLSSLTQDAPVSCL

SEQ ID NO: 790211 - protein, 68 aa, Homo sapiens
MLELLRTLGFYYILHFLGSLIHALGFKYHLSDSISNIDLSSEFQNLAILLDVSWVLQYSVSSYLTETF

SEQ ID NO: 790212 - protein, 39 aa, Homo sapiens
MAVLARQLQRLLWTACKKKEREKEGREEEEEEEAGRRAP

SEQ ID NO: 790213 - protein, 128 aa, Homo sapiens
RVPGGTCLEARHCTGPSDTACAACLGAWEMTVICDLAGPRKPILQMRKLRPKGTKRPLSASPRALEGGVGLRPCAQRAQQQEGSWASSSPPSEASQSDRKVRGPGEGAGPGSGNFLSLSVGSVHLITP

SEQ ID NO: 790214 - protein, 105 aa, Homo sapiens
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPV

SEQ ID NO: 790215 - protein, 108 aa, Homo sapiens
GYAPSPCPGCYVYTPTRILTSCLQVAFFNSAGANAQEEQRVCCQPLAHPVASSQKKPEVAAPAPESGGESVFGETHRALQGAMEKLQVSRSWHGPTRGAGGQDKAGDS

SEQ ID NO: 790216 - protein, 92 aa, Homo sapiens
SGPSADRLLHTPQRSLLPADSTALPGLALAQLPATIVPTTEPLHRPLPQTRQPLVHSLKPSSGVTSSKKPSSPPPAGSEDLPLCSLGHLCYL

SEQ ID NO: 790217 - protein, 95 aa, Homo sapiens
GGCAGARAEPFVQENIPQRQPPHLESLWFLFQALPWRNSRRVCSSQAWLLAHPTSWPSTGPLTSLNLNFLTCRMGTKILTSNDRCEIKLNAKTQM

SEQ ID NO: 790218 - protein, 86 aa, Homo sapiens
MGLEALNENLPEINIDLTYKQGRLQFRPPFEEIRAKYYREMKRFIGIPNQFKGVGEAGDESIFSIMIDRNASGFLTIFSKAEDLFR

SEQ ID NO: 790219 - protein, 110 aa, Homo sapiens
DGALRQPSGAGSGRGTIRWGLRARPLKPWTGVRERRVSPARTAEAPPPWSPLWGGLAGAGWGRPALVGLSPLELGGSLRRAERTQCRGSERRPRESWGWRTHVLPALGWA

SEQ ID NO: 790220 - protein, 53 aa, Homo sapiens
MSKRYLQTAHNGNTANTHIHVHLVGHSWIHAANPHTSSPWLTTANSVTVRGPP

SEQ ID NO: 790221 - protein, 51 aa, Homo sapiens
MSRSIFRCFSSCFRFALAAMAAAPREEAGRAGSRAALRRGPAVPRAALAAA

SEQ ID NO: 790222 - protein, 102 aa, Homo sapiens
MRQKSLPCSLWALCQCLPWEAPGCAVDPSLWRTLAWPLPTPLEPLLRALCYKGPEKGPWGGGYMEATFIHSFTDSFNRYTLYLYCVYLLSPSLGILSWLRYG

SEQ ID NO: 790223 - protein, 102 aa, Homo sapiens
TGSYQKRTKKRNEPIVAEEKHAEICFKFTLNHRRSGNSTHQELSHSRKWAQPTIHTMETRMARKCHRSGTSICRISVHSSTILTKFKGKQTLSHTNMGIQNC

SEQ ID NO: 790224 - protein, 149 aa, Homo sapiens
NSIAFHAAKCTLISREDVEALYTSCKTERVLKTKRRRVGRALATKAPPPERAAAASPRPGFWKDKHQLWRGLSGAARPLPISAQSQRPGAAAARPAAHLPQIFSKYPGSHYPEIVRSPCKPPLNYETAPLQGNYVAFPSDPAYFRSLLC

SEQ ID NO: 790225 - protein, 104 aa, Homo sapiens
LGLMLLLSIRKRSPYHSSDTLQNLRIMVLHNVSEGIHPPTQELKWNLPHPTCGISPRLLFRQILICLVVILLGTMQSKLFHLVIFIPFPSLIVSFTTDSSSSFQ

SEQ ID NO: 790226 - protein, 102 aa, Homo sapiens
GPSSPADVALSARCLGAYSTLLTGLRPHQPCLELAPPPVITPARLQMSKVLLGSHKLSSASQVRHTTIPHCFPSSSHSKHTGRVLNPILHMSLNDLLEVTQS

SEQ ID NO: 790227 - protein, 104 aa, Homo sapiens
MLYYTLPCQARSPHACGLSMGHPVLGQGKKEVKYNLTRTISPPPSGSLQHLARTTCALCWALPLSQMCCEALPCLKLNFLRPRALASLRALLVCSGFPGSAYHQ

SEQ ID NO: 790228 - protein, 143 aa, Homo sapiens
RSPQVAFLLAQGSQSGCTGRSPGEMFKSLRLYPTQIKSEPLREGISSSQLGSHVQPRAEPHCLGRRNEGVQGAPDQKEAAEESSQGALKPLSFLGWVPICLEYLFFGLYGTAIIHPKFRWAKIRTLFFAVTSFLTLSPHSGIL

SEQ ID NO: 790229 - protein, 614 aa, Homo sapiens
THTRTAYSALPARSHCPQARPARGKCVPRRSHRRDQERSARSLREPAQGSSGCSWIRAPQRSVAAAGTPWAAPRTAAPQTTSNRARPRRGWRAQGRHPASSWAPGHPYERRRSRAKEQDARQQDSSASPAGPLFPRPPGAQEAKCNHRATAERGRGQRHPLARNPVPAAAARPGRGPSGPGVSSSRRRGSGPGLAGAGEEGRDGGRARGRGGGPERIKMAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 790230 - protein, 165 aa, Homo sapiens
MIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRLTHPQSSLHLLGIKTVSKNVPVYHLPSLTLFLWPHNC

SEQ ID NO: 790231 - protein, 236 aa, Homo sapiens
MIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEFCHT

SEQ ID NO: 790232 - protein, 93 aa, Homo sapiens
TIITYPWFQNSSVILLLNKKDLPEEKIMYSHLVDYFPEYDGPQRDAQAAREFILKMFVDLNPVTKLSTPTSHAPQTPRISALCLLPSRTPSSS

SEQ ID NO: 790233 - protein, 93 aa, Homo sapiens
GIIMDVVPVLEVPKLKVCALHVSSRSTAASSSLGKTLTFAQLALAFPRPVASACSPILTRAKVYRHFGQAWGTPHSHTKPYVHPKGQPQLKKN

SEQ ID NO: 790234 - protein, 39 aa, Homo sapiens
MSLGFYFDRDDVALEGVSHFFRELAEEKREGYERLLKMQ

SEQ ID NO: 790235 - protein, 73 aa, Homo sapiens
MQLRFAPFSEQATTLTQGSTQATGYDLNGAYDDTIPPMEKALGKMDIQIALPSGCYRRVAPWFGLAAKHFIDR

SEQ ID NO: 790236 - protein, 83 aa, Homo sapiens
AILEKHRTVRRPLLRLVTMKAMTSSLRFVVTGLCNYGQVISILVPVKLEGRKVKKRAAGVPPSWSILYSWGAIQAGSPRERSI

SEQ ID NO: 790237 - protein, 105 aa, Homo sapiens
LCSKPCNLSSFHQNKSKSLQRAASPHMIHSSPHTRYLFDLIWYYPPSLTLPQPQWPSCSFSNRPGMVLALESLHRQFPLLGVTIATIFISFKCCFGIEAYPHFLI

SEQ ID NO: 790238 - protein, 168 aa, Homo sapiens
SSSRSCGSRCISSRIWRYSSFWLSSNMPCSSQGPWGGTLPASSPRTAQAGGGGSIMRKEPFPSPLHTHPTSASRSAGITGMRHRAQPPKLLKLISNFSKVSSYKINVQEIVIAFLYTNNNRAESQIMSELPLTIATRRIRYLAIQVTREVKDLYKENNKPLLKEIRED

SEQ ID NO: 790239 - protein, 108 aa, Homo sapiens
PGSPGGGRSPGSPGFPGGGRSPGSPGTWSGYISTSVPVALGRTARLASGPRPQQTNTGPQQVSEVPALGSLLAFPPPKSGRGTKPALFLYECSGPHLAMNRGVGWETG

SEQ ID NO: 790240 - protein, 110 aa, Homo sapiens [sequence omitted]

SEQ ID NO: 790241 - protein, 51 aa, Homo sapiens
MLKCNMVVLSAKRGPERALNTHERFSPKFSKYVQGTRCGSSSVLDTGDPAA

SEQ ID NO: 790242 - protein, 75 aa, Homo sapiens
SSIDITEITLYELCQFTGLGKMYENLPVTGLDDDVPTKAIEVQNESGGEEVTEVKVASREIYGSRLLRVPRRDRL

SEQ ID NO: 790243 - protein, 100 aa, Homo sapiens
LACCSPGTWLKLSSCREWWGLTGHPCRICTLQCPPLLSTPQPQPLGPYKAGKGPPGRGEAAALQEFHTGPVLPLLLQEPPGEVRPSSRPCAPGDAHSTST

SEQ ID NO: 790244 - protein, 85 aa, Homo sapiens
PGGSPKERVRSKDRCSSEFLWNLARCRAWTQGFHEAVKEVARKLNLVWRARRGFGTEGQSSRLRGSCRKEHAFSQRLSTLHGDSC

SEQ ID NO: 790245 - protein, 106 aa, Homo sapiens
PALPPPLREDPLARCCLCTQASHQKRRHPTRRGECGPTLALNPARLPCTRDPFPCLPADGTSVPLAVLSSQSRASTRLCLPPEMLLFTPYHWCSLVLHLRRDLRIR

SEQ ID NO: 790246 - protein, 89 aa, Homo sapiens
EVTLAFFPGEVRQSPVCSEQYRQGFTKRAGAGKGPGGWLGFPQGQFQGHKMACLGEDFKTGQDKGVFGKWIQCVGTSEVRRQAQTISFT

SEQ ID NO: 790247 - protein, 51 aa, Homo sapiens
REEGVRREEGGILPNSFYEAKHYSDTKARPGQHKKRKLYANSPDEHRCKNP

SEQ ID NO: 790248 - protein, 102 aa, Homo sapiens [sequence omitted]

SEQ ID NO: 790249 - protein, 174 aa, Homo sapiens
SDLPPKCMQEIPQEQIKEIKKEQLSGSPWILLRENEVSTLYKGEYHRAPVAIKVFKKLQAGSIAIVRQTFNKEIKTMKKFESPNILRIFGICIDETVTPPQFSIVMEYCELGTLRELLDREKDLTLGKRMVLVLGAARGLYRLHHSEAPELHGKIRSSNFLVTQGYQVKIWVPG

SEQ ID NO: 790250 - protein, 111 aa, Homo sapiens
NLHYSHEVEYSRHHKKVLLYPSAVNPFPIPPAPDLLSDSVSVLPFLELHINGVIQYVLDWLLSLSIMLLRVIHVALSVVHLFSLLCRIPQCVYLCTRQVVSSMWQLWKKLL

SEQ ID NO: 790251 - protein, 67 aa, Homo sapiens
CPKLEAAPAKHWKHPALHQDKPREPQLAGNIPSPSSPLLSPDLPHLPGLQTLAVAVPTPGTPFPPGT

SEQ ID NO: 790252 - protein, 797 aa, Homo sapiens
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRASEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 790253 - protein, 241 aa, Homo sapiens
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVTDCQVAQRMSTRLTQETRCGQRGTLAWTWRNGHKRWLRNAAPGKTQSRQPPKRGAR

SEQ ID NO: 790254 - protein, 705 aa, Homo sapiens
MGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRASEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 790255 - protein, 80 aa, Homo sapiens
AFLLYTIRRGPAGIGRTGRGMGGLFSVGETTAKVLKDEIDVKFKDVAGCEEAKLEIMEFVNFLKNPKQYQDLGAKIPKVK

SEQ ID NO: 790256 - protein, 30 aa, Homo sapiens
MEGHCCGYQMAQGDSVEKYFVSKKNQSVLI

SEQ ID NO: 790257 - protein, 42 aa, Homo sapiens
NGMEWNGTECNVMEWNGINPSAGEWNGMECNGMESSGMEWNG

SEQ ID NO: 790258 - protein, 116 aa, Homo sapiens
PENSQGTETESIPHRAEGRPGSHTARVPGSRSPRRACHRQHRYCHCQDAGTVAGPEWMQTPPCSAGCTFWTGRDLTVTLGARPTQGAGQGGGPHHSMKRTQQKGESERGEGVRPTH

SEQ ID NO: 790259 - protein, 98 aa, Homo sapiens
QPALYSPGVVLKRFSGRHRLVGVVQSALRSLRQPEADKGRSRSPRSPLPLPNKRRKKNLVLDEKINACHLPLQLETATCPQNKRLQGGDWSCRPGSFV

SEQ ID NO: 790260 - protein, 108 aa, Homo sapiens
MTTSQTPSELSSWSLKLSNCSPSIFHLIHPRSSSLHSLFSSISPSKPVHHKVLLSIFIAKSLSNRSDFQSPLFCHPNASHCTVLSFSLVRCLLHTLCTPCSLFYYQQP

SEQ ID NO: 790261 - protein, 340 aa, Homo sapiens
ADAVEMQGPPLLTAAHLLCVCTAALAVAPGPRFLVTAPGIIRPGGNVTIGVELLEHCPSQVTVKAELLKTASNLTVSVLEAEGVFEKGKINSIKSYPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGL

SEQ ID NO: 790262 - protein, 102 aa, Homo sapiens
SRDELLHAWEFWRAQWKEGARAGGGDRKGKGNPRRFQHPLFRKTESLPGQLLRSHHKLKSRPPVWSVPFLATLSSPKLQLVPCSPPVLARLSGEAAAPPASR

SEQ ID NO: 790263 - protein, 85 aa, Homo sapiens
HGLCPSCVLCPAGCTSAPCGSLPLSLSKCPEPLSPTAAPLYPGSAALLLHDVCLPTADGAMNVDASFTAVCRHPEQDWSPEQAPD

SEQ ID NO: 790264 - protein, 128 aa, Homo sapiens
MRKAPPWAVGAVARARRAYEQRDPTGGLPPSAVAAGLMHRRPQGSVRTGSTRRPVRPWRHSRARRNMIPVTEFRQFSEQQPAFRVLKPWWDVFTDYLSVAMLMIGVFGCTLQNSEFKSSLKDTQNCHQ

SEQ ID NO: 790265 - protein, 174 aa, Homo sapiens
MASPEPRRGGDGAAQAARKTRVEGNSLLSKNSGSLNEAEALNPEVTLSSEGSLNLEDILYLEDTGDLDETLYVQETEKAEEALYIEEAMQPDEALHVEEPGNPEETVCVEETTEPDRIQFVEGPVEPGKPTSPEHVVYEGETVTRAEKSNPEESLRAEQSPSMEENLSIEDLEL

SEQ ID NO: 790266 - protein, 113 aa, Homo sapiens
SLREFLLHGLRCQLFLGLQPAGFRLELHSWLPGPPAGRHTLQILGLVTLHARVSQSLEISFSLHVHSLLVSLETPDEYTNQCRFVAQQTQCAGAARTGLQEPTVKFLGILCAS

SEQ ID NO: 790267 - protein, 196 aa, Homo sapiens
LGASLKDEILKVTPVQKQTRAGQSTRFKAFVAIGDYNGHVGLGVKCSKEVATTIRKAIILAKLSIVPVHRGYWGNKIGKPHTVPCKVTGRCGSVLVCLIPAPRGTGIVSAPVPKKLLMMAGIDDCYTSARGCNATLGNFAKATFDAISKTYSYLTPDLWKDTVFTKSPYQEFTDHLVKTHTRVSVQRTQAPAVATT

SEQ ID NO: 790268 - protein, 86 aa, Homo sapiens
CLFPFKKGVVATPAKKADVTPGKKAAATPAKKTVTPAAFHFRVKPAEGPPSSGSLTFMTPRLSLPIPPTFSFSLFFFFLRFEGKRP

SEQ ID NO: 790269 - protein, 129 aa, Homo sapiens
IRFIRPFQLPRLPEVLGLGQALSPCFLETLIFLVCNMKSALAPPPTPYHLPMEGRLQGRAAASPLLRHHHSQHRQGHSSGSLGPPCASQHSLPHPHSPRTRLPQKVTTGPGLRLQGTRRHCQPGVHQAW

SEQ ID NO: 790270 - protein, 121 aa, Homo sapiens
VEMGSSYVAQAALELLGSSHLLASASQSAGITGVSHHAWHVFSSAEEKNHNVSGSEAPDPGDGSPGRPEESFSRNLAIATCLRRQGKGPGWHRGERWGLGRTWQPAPLNDIQLSRIWKINL

SEQ ID NO: 790271 - protein, 393 aa, Homo sapiens
MDPKRSQKESVLITGGSGYFGFRLGCALNQNGVHVILFDISSPAQTIPEGIKFIQGDIRHLSDVEKAFQDADVTCVFHIASYGMSGREQLNRNLIKEVNVRGTDNILQVCQRRRVPRLVYTSTFNVIFGGQVIRNGDESLPYLPLHLHPDHYSRTKSIAEQKVLEANATPLDRGDGVLRTCALRPAGIYGPGEQRHLPRIVSYIEKGLFKFVYGDPRSLVEFVHVDNLVQAHILASEALRADKGHIASGQPYFISDGRPVNNFEFFRPLVEGLGYTFPSTRLPLTLVYCFAFLTEMVHFILGRLYNFQPFLTRTEVYKTGVTHYFSLEKAKKELGYKAQPFDLQEAVEWFKAHGHGRSSGSRDSECFVWDGLLVFLLIIAVLMWLPSSVILSL

SEQ ID NO: 790272 - protein, 393 aa, Homo sapiens; identical to SEQ ID NO: 790271

SEQ ID NO: 790273 - protein, 45 aa, Homo sapiens
ILQVEVLTLLCSLFSDQPWRPWGLGGVAAYSLGEVWAASPLSGQV

SEQ ID NO: 790274 - protein, 69 aa, Homo sapiens
DKKKPPESLHIVRRVSMLPRYTVGYYMILTHLRKENRNYQLTKMGFEETKYDSVYTVLSVKRKSCIQEM

SEQ ID NO: 790275 - protein, 124 aa, Homo sapiens
KISKGANPVEIRRGVMLVVDAVIAELKKQSKPVTTPEEIAQVATISANGDKEIGNISDAMKKVGRKGVITVKDGKTLNDELEIIEGIKFDRGYISPYFINTSKGQKCEFQDAYVLLSEKKISSV

SEQ ID NO: 790276 - protein, 85 aa, Homo sapiens
PIGGPSRTPQQPRPAPHLRVTGMIRLSPGPRGPGTRGQRAVGTAQPRTLLRECGSFGLERDVLARLPTNLQFPRAPLKQELFPKP

SEQ ID NO: 790277 - protein, 194 aa, Homo sapiens
APAHTSAAALPGSHPSAGGGPRVLRALPPLAGWTPQGQRRSLRPTSRVPPGTGTGRRAPTVLLVQHHGPDGSSRTSAEDTEGRVAPTPAAGRLRCSRRPRAGAESGEPRPPTGADGPESGAQPRGQGAQEEGLGGRRGGETARPGSREPREQQLPGPGRSRSLSRARVLPPRRPYSPQQSEGCISQGPSDSPVN

SEQ ID NO: 790278 - protein, 130 aa, Homo sapiens
RSSSVQCRHTPMCCALPVSLSQAPAWKQRWTRNLPTHPLPGYRHHFHHKTESGFRDSAQGRSSGHLPLSEGRFLLPLAQPFPLFPPMSCHWSTHLGAGEREEEGDQVTPSWLVTLCPGNRRLELILMAEA

SEQ ID NO: 790279 - protein, 119 aa, Homo sapiens [sequence omitted]

SEQ ID NO: 790280 - protein, 103 aa, Homo sapiens
ISGLPKQMSNIPPILASLLFHGDFCPTTSDPGVHRRTIQVSFWNSPSLESLLQDRCLSDSRTAPSPRHEVPFYYQTSTASPRLGQTHPEMQGQNYDVPTCLHK

SEQ ID NO: 790281 - protein, 163 aa, Homo sapiens [sequence omitted]

SEQ ID NO: 790282 - protein, 169 aa, Homo sapiens
QWEGNSFWVQTKSWLVTLTNTTTTCLRLSAHENQQTSKIALHNTECGTSRKFRGNEIANVRDRVKDCILSLFPPKLVLPLPWNKEQLSKGRERKQSNEEFQPPILSGESWRVLFPNSAIGRKPEVRPLHQEKEMQTAQVTQIPEPCLHKGVSFHVAAQYVKDESLILSK

SEQ ID NO: 790283 - protein, 143 aa, Homo sapiens
LQLGLFKHLSWQGKRGSLSGTSILLVATFMVCVFVCVLSHKGGCGRGAPLREEVNSARVARGAACVPGGAVHAVPGPALKSPNSPGLSPAPALLGRGRPLVKGMGAPLPTGRDGAPPLRPVGELRNLLGRFWAEGGLFWLGAV

SEQ ID NO: 790284 - protein, 76 aa, Homo sapiens
TCRGSYCNPSALEGKVVGSPEARSSRQTRATQQDPVSTKIEKISWAQWHTPVIPALWEAKAEGLLEARSLRLAWPT

SEQ ID NO: 790285 - protein, 110 aa, Homo sapiens
PRQRAGDCGSVPEAGREPAELGEEPPTPGAEHVRINKMKLGETGGQIAPGSRSPRPGRSTSPPYPSPAAAPTPGRSPRGSCSPGAPPPARAPSPARGRFAAVINKEGRQA

SEQ ID NO: 790286 - protein, 96 aa, Homo sapiens
SPARGHVHRLSPVRRPDVLRINKMKLGETGGQIAPGSRSPRPGRSTSPPYPSPAAAPTPGRSPRGSCSPGAPPPARAPSPARGRFAAVINKEGRQA

SEQ ID NO: 790287 - protein, 150 aa, Homo sapiens
GKENKITITNDKGRLSKEDIERMVQEAEKYKAEDEKQRDKVSSKNSLEFYAFNMKATVEDEKLQGKINDEDKQKILDKCNEIINWLDKNTAEKEEFEHQQKELEKVCNPIITKLYQSAGGMPGGMPGGFPGGGAPPSGGASSGPTIEEVD

SEQ ID NO: 790288 - protein, 150 aa, Homo sapiens; identical to SEQ ID NO: 790287

SEQ ID NO: 790289 - protein, 195 aa, Homo sapiens
VGVRARGSDVTARLRRPRSASRREPQVRGGGGGAGSGRLGPLPPGGRRGCGRTGVKSGRRGGGRGAARASFGRDVSGSAPRQVAPVESDPSAPLPAAELQGGEAAHSKLAARLRGAAGRAACGAGGQRGLTPPPSAPALCRQASGEAGSFPPGLALSPARDPSPTVNPTGKAQNCAGLRPSAVEPLRVSLPPPAA

SEQ ID NO: 790290 - protein, 77 aa, Homo sapiens
PCTLRAVILSGLGELTGSWQGWRERGTEASGGHTWVFSGPGPAALLWGGAFTVSSSTPLEILLMGQGHHTWAPTFPN

SEQ ID NO: 790291 - protein, 82 aa, Homo sapiens
ICHGEHMDSWAIPKNNFWVKQQCQLLAPTAFTYEWSHVQSRLFWASLRRGSHDDIGTFGHHVHQPGTSMRAPLLIVPAGLAG

SEQ ID NO: 790292 - protein, 123 aa, Homo sapiens
DGATTEQSHALKLVTFYPEHRVNAHRFCNTGYKDSKTALLFASFVTSSKLLKFLSLRYCIHKRAVAKLVPASSGCCGVESELICVRSRGQCLLHKHFVSVIIAFKTLFTVCVRLSSVLHRLSV

SEQ ID NO: 790293 - protein, 520 aa, Homo sapiens
WFLTLNLKSVEMNNEEDLLQEDSTRDEGNETEANSMNTLRRTRKKVTKPYVCSTEVGETDMSNSNDCMRDSSQILTPPQLSSRMKHIRQAMAKNRLQFVRFEATDLHGVSRSKTIPAHFFQEKVSHGVCMPRGYLEVIPNPKDNEMNNIRATCFNSDIVLMPELSTFRVLPWADRTARVICDTFTVTGEPLLTSPRYIAKRQLSHLQASGFSLLSAFIYDFCIFGVPEILNSKIISFPALTFLNNHDQPFMQELVDGLYHTGANVESFSSSTRPGQMEISFLPEFGISSADNAFTLRTGVKEVARKYNYIASFFIETGFCDSGILSHSLWDVDRKKNMFCSTSGTEQLTITGKKWLAGLLKHSAALSCLMAPSVSCRKRYSKDRKDLKKSVPTTWGYNDNSCIFNIKCHGEKGTRIENKLGSATANPYLVLAATVAAGLDGLHSSNEVLAGPDESTDFYQVEPSEIPLKLEDALVALEEDQCLRQALGETFIRYFVAMKKYELENEEIAAERNKFLEYFI

SEQ ID NO: 790294 - protein, 290 aa, Homo sapiens
ELSPYNLYFYSLDSSGNQNLYATYQLSHFQSISVLGNLEARMVDTVLYDNTQLQLKAESPWEALDWGQKLWEVVHAAVPGYMGRQNELTISPGLGHHDDYTQNHSFQKKTSGLLPPSPVLDSSKQYQNILKSGTLYRLTVQNNWKAFTFVLSRAYLMAFQPGKLDEDPLLSYNVDVCLAVQMDNLDGCDSCFQVIFPQDVLRLRAETRQRAQEWMEALKIAANVARSSEQNLQVTLRNKPKDQMGGHELRKNKRQSVTTSFLSILTTLSLERGLTAQSFKCAGMKQIFSL

SEQ ID NO: 790295 - protein, 100 aa, Homo sapiens
WSARLTSGSAKWKGPDSVRSKYEYLEDTQTDEAPWNLLLWSALGISCMSDHEVAPHFCLPGLREVGALVRGVSSAQQREPHLVSTGWNPGSSRSDGEEVW

SEQ ID NO: 790296 - protein, 96 aa, Homo sapiens
KDNKLLLLHLAHLTVDFSREDAVTEFEEQDLSWKSTPVKARGYKQNCAEEEGKPQCRPNCASTDVAKSKVNVAYQTFYIGPAWSGNYIPAWVSHCM

SEQ ID NO: 790297 - protein, 116 aa, Homo sapiens
GAAPLAQARARLDMATYCDDLGPSSAPPGQAQATAHPPGYEPGDLGAVGGGPLLWVNAPALSPKSYASGPGPAPPYAAPSYGAPGPLLGAPGGLAGADLAWLSLSGQQELLRLVRP

SEQ ID NO: 790298 - protein, 190 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGTRG

SEQ ID NO: 790299 - protein, 336 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEVRASVLNFLTRCHNLRVSKGQGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQVVAWQCALQGGSSSHPANYLSSLTPAQGFQILCDLHDGFSGVGAKAAELLQDEYSGRGIITWGLLPGPYHRGVSGTWRSKHSNPIGRVA

SEQ ID NO: 790300 - protein, 342 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEHSFSKGLRLGEQKGGYAVWPANSRRMKQPLPLNCLELNVDFSDPSQGVLSSDGVWRVKSIPNGKGSSPLPTATTPKPLIPTEASIRVWSDFLRVHLHPRSICMIQKYNHDGYGDPRGFEEAGRLEAFGQGESVLKEPKYQEELEDRLHFYVEECDYLQGFQILCDLHDGFSGVGAKAAELLQDEYSGRGIITWGLLPGPYHRGVSGTWRSKHSNPIGRVA

SEQ ID NO: 790301 - protein, 208 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEWKLGRDLTKLDLRRWASFMDAGVEHDDVAELLQELQSLAQCYQGGDSLVD

SEQ ID NO: 790302 - protein, 154 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEASIRVWSDFLRVHLHPRSICMIQKYNHDGTRG

SEQ ID NO: 790303 - protein, 119 aa, Homo sapiens
GGSNPFPMAKVRLLQILMDGGLGRAETWRKVHFLCLSSGSSPLPTATTPKPLIPTEASIRVWSDFLRVHLHPRSICMIQKYNHDGYGDPRGFEARNMGPHQCRMRLLRPSSLPFPRTRG

SEQ ID NO: 790304 - protein, 138 aa, Homo sapiens
SLIAQVLEVHLDLLAVLLQQGFTCVGRDSRCYRMSEFPTYALSLNGTYPNLVGQGGQIHSAREASLNWWEKRPPAPGSRISFHRRSLHLPLIISPSDNLGLSWDKVSVSQGLCTLISSSPTEAGKCFISRGSINVECK

SEQ ID NO: 790305 - protein, 1036 aa, Homo sapiens
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 790306 - protein, 502 aa, Homo sapiens
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINSE

SEQ ID NO: 790307 - protein, 142 aa, Homo sapiens
MANSGMVVYRLAGNFLYSGTQGPSLLWLYNLPRGFSCICVQPAKGSRAWEVSTGGFAGRACKWCTCLALTTPGQSSVSWPRPTVKEAGKCSPCAQEQKEKESWEQLMVSATGSRAGVAQTSGLPAGGAHYFLFCLISSFKKK

SEQ ID NO: 790308 - protein, 165 aa, Homo sapiens
CGRRTIRGQLAVSDLWVEGHWLCQACVRRAIGCVSLWAKGDWLCQACGRRAIGCVRPVSEERWLCQACGRSAIGCVRLVGQGRLAVSGLWEEREWLFQARGPRAIGCVRPVGGGRLERERQVKSWGKHRGWLWPGKERGPKHLLAAWSDHGAGDCIVSMSAPEVK

SEQ ID NO: 790309 - protein, 102 aa, Homo sapiens
SSHFDLPKCCNYRHEPPCPVPCILSGVLGGWWGGPWGGEHSMESQFEGQDSGLRHSQVGPSRHLDPGVQGSGRDLAGSTSPGLSPLRVMGTLSISEITRESV

SEQ ID NO: 790310 - protein, 221 aa, Homo sapiens
IYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLCEYKCEQTVRHSPSFSST

SEQ ID NO: 790311 - protein, 318 aa, Homo sapiens
IYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLWKLGFIVSNLGPDKLEFQLGLFGKFLFFPPFCMACQAAADELYTIVLFRVSYEQSSSGNSCSLVFCLLTRCWFFTNISRVEGLAVLYLASTTTSSASLSLLSLPFQNERCIDNTV

SEQ ID NO: 790312 - protein, 209 aa, Homo sapiens
IYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLYASFIC

SEQ ID NO: 790313 - protein, 221 aa, Homo sapiens; identical to SEQ ID NO: 790310

SEQ ID NO: 790314 - protein, 111 aa, Homo sapiens
SDECIEEDDLLGYSASRIQKIRLLKSNIRSHCCFYSRDWVSLCFPGRSLTTGLKYLSAAASQSDGIRGISHPTQPQPRLNLNNGFFIIFRQYTFYNFLFLIYFSNKNTLTL

SEQ ID NO: 790315 - protein, 58 aa, Homo sapiens
MVLGRCERYLEGGFKFGKFGKSSKGTILGLSPVGVWEAGRAGEAGLGPRWAQLPSVIA

SEQ ID NO: 790316 - protein, 77 aa, Homo sapiens
TPTPTPNKGSSRGSCQLQSQLLDTYCPRLGVKRFRLKDPSVDCSQNSRGLSFGLAGAIPTCVQEAPHSAGAGGRRRS

SEQ ID NO: 790317 - protein, 109 aa, Homo sapiens
DKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIW

SEQ ID NO: 790318 - protein, 131 aa, Homo sapiens
DKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWFGYLKDLTGKLCEEVVRAEGYF

SEQ ID NO: 790319 - protein, 82 aa, Homo sapiens
MLISKIDVQVECYIISEEEASSPSLRGENGLVEEWSLNSVLKYVQDCFMWKAERKNIPGDEMFQQGHRAEESNSNRNWLAWT

SEQ ID NO: 790320 - protein, 175 aa, Homo sapiens
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKVRMRTSLDLCQCLLLSKVFSEVVMQVQILESMRCSGTIQGKFHSSPPAKPHYPWAYGPVFTNISWATTICHIPN

SEQ ID NO: 790321 - protein, 236 aa, Homo sapiens
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDVMERVSDDYNWTFRFTGRVIKDVINMGSYNFLGLAAKYDESMRTIKDVLEVYGTGVASTRHEMGTLDKHKELEDLVAKFLNVEAAMVFGMGFATNSM

SEQ ID NO: 790322 - protein, 150 aa, Homo sapiens
FFFLGKCQQAEGLGHMVVKYDLLLKQLQSIFQNDCIIIHSRQPSLKVPVPPHLGKLLLLLLRRRFPLVAQAGVQWRDLSSSPPLPPRFKLFSCLSLPSSWDYRNAPPCPANFLFSVETGFLHVDQAGLELLTSGDPPASASQSAGITGMS

SEQ ID NO: 790323 - protein, 113 aa, Homo sapiens
MPKKTRAKETPLLFLPSSGISCWSSSSPRSLLLRPEVSLSFLPWVPALCPQPIMPAVHASCTQDFLLGLGLGLDNDPDDPRGHWGPGSFAAELASSSHPFTCFLILSPQALSS

SEQ ID NO: 790324 - protein, 129 aa, Homo sapiens
VTRVLLRDLIRRLGLPFWIGSDNGPAFVADLLQKTAKVLGITRKLHAASRPQSSGKVERMNRTIKNNIIVFPAGYVKQHHEGHQTTCYIGGNLILSPPPPVPDIRGNNTGVMYTHCFIGSNVILCLLGY

SEQ ID NO: 790325 - protein, 72 aa, Homo sapiens
GFGSCQLVPATPYSGPLKPVRGWQPCDTSPHSATESEIEVEVGEYVVAVRAAFCKMLPGGACDSRPSSLQRK

SEQ ID NO: 790326 - protein, 31 aa, Homo sapiens
MRSGWLWSRDLHSHFGPDTHWLCLNLSFLLG

SEQ ID NO: 790327 - protein, 65 aa, Homo sapiens
MQAVLVWLSLVPLCFSRALQVMLKYSRLRTAALGQGRPIETQHEPKMCFSLSSGHIKKMQMKLKA

SEQ ID NO: 790328 - protein, 107 aa, Homo sapiens
WSWLLTRWTHVPFFLRNVVILKCLALRLALRLLCLWKAVWSHVAPSSAPMLSQNTTINDRAGRWLKKICGRAQWLMPVIPALWEAEAGGSRGQGIETILANMVKPCL

SEQ ID NO: 790329 - protein, 87 aa, Homo sapiens
PTEWNISLDPAVFDSFWQDTEILNTAVLTGKTVAMPIKVVSVEENSAVMDISESVECKSTDEDVIKVSHSTASWMEPVGTSLGHPVC

SEQ ID NO: 790330 - protein, 71 aa, Homo sapiens
APIEAEAAGPAGRPPPGARLPGAREGAALGGGARAPPEAAAAVSPPLLPAWHLPPARAGIAADKPASNFSK

SEQ ID NO: 790331 - protein, 71 aa, Homo sapiens; identical to SEQ ID NO: 790330

SEQ ID NO: 790332 - protein, 100 aa, Homo sapiens
APIEAEAAGPAGRPPPGARLPGAREGAALGGGARAPPEAAAAINLPVISANETWNTSRPEDGKGSSFDKRRPAWLGILSPAGWEMQRCFQRGADELRGKK

SEQ ID NO: 790333 - protein, 103 aa, Homo sapiens
LQEFFLSWDLKLSSGCLLLSSCLLSSYREMVQSINLAGRVGKGAYLEVEFSWKMHCFLLTCMFTGDGLGKPIEVLLEGSTSSSPTKYPLKLTLSSWAGKHQQS

SEQ ID NO: 790334 - protein, 115 aa, Homo sapiens
MLSKNNVLVVLKEPLENISWPACPSARVQSPPHRGLPGPSLQGVWALLLQVRRPKLREAGQLPQGHSEWVRPGLGTRKPRPCSEAQDKCPLTTPSWSSGCRSRRQSPEGLISTWG

SEQ ID NO: 790335 - protein, 39 aa, Homo sapiens
MSKCRGGKITPKWFFVESHCLLENVSPCVATFYSFLRKT

SEQ ID NO: 790336 - protein, 89 aa, Homo sapiens
SPFQVFSPQIKLSFQMLHQSVPFRGRCIAKSHSPSQFLSYLACWRHPAQLLVSFFTDFTFFTGSRLLHSLFSFYMGSRRKLPSGTVAEP

SEQ ID NO: 790337 - protein, 110 aa, Homo sapiens
SHACPHCRASELLLYRESVRMWYVHNLLSIFYSLLCLFEVVYPNFLFPSSLTSLSSLAPGCCILSFPSTWVVEGNYQVGLLLSPEAQSLRPSPLQLRFTSEYGDFIQSHG

SEQ ID NO: 790338 - protein, 247 aa, Homo sapiens
CLEGAVRAGRIPRVPLTHAGWGQGWTLARTRSLLIMLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEWMQNVLGQVLDALEYLHHLDIIHRNLKPSNIILISSDHCKLQDLSSNVLMTDKAKWNIRAEEEPFVSPGMALKPQFSFSR

SEQ ID NO: 790339 - protein, 119 aa, Homo sapiens
CLEGAVRAGRIPRVPLTHAGWGQGWTLARTRSLLIMLGPGSNRRRPTQGERGPGSPGEPMEKYQVLYQLNPGALGVNLVVEEMETKVKHVIKQVECMDDHYASQALEEQWGLTILPRLV

SEQ ID NO: 790340 - protein, 171 aa, Homo sapiens
WIVSICRYGQHLYGMKVIITIVTVIIIIITTSDFLNANQAPVIKREPRCKDGGRLSILREPLRPVGKARFRHQGQAAWDDRWNKEETQEPPPQPRNPHHRPDLHDRQAPDSGYEGVSPKRVAEANFSLGSAPQAAQGRSHGQSPGVHGFFSHGSPAASSDIMKRLPPPGLF

SEQ ID NO: 790341 - protein, 167 aa, Homo sapiens
QLQPSQLLHDCFVIITIVTVIIIIITTSDFLNANQAPVIKREPRCKDGGRLSILREPLRPVGKARFRHQGQAAWDDRWNKEETQEPPPQPRNPHHRPDLHDRQAPDSGYEGVSPKRVAEANFSLGSAPQAAQGRSHGQSPGVHGFFSHGSPAASSDIMKRLPPPGLF

SEQ ID NO: 790342 - protein, 149 aa, Homo sapiens
RLSRVVGRGRQGDGAVPPDADLRGRAHTVAGLAAAGGGAQGTAALVAHGPRLLLVDGLVVQPQDLLQAQRVPGAPGRAAGCPGLPRPLAAHCLSPRLPAARRASRLSHPAGGRCARQSRRVPASPQLRSIVVARRRLTIPGTAAAQRGR

SEQ ID NO: 790343 - protein, 104 aa, Homo sapiens
PQNPYSFSEFPPEARWALPGAFSGNSETFRRCMVCVLPENHGPSYSWHSHGHQDQPGPNSDSRVLLLREVAQSQVPSMAADCQEQWLGAAAPPNPACRTGTTES

SEQ ID NO: 790344 - protein, 52 aa, Homo sapiens
MISTVCYLSPSPSSSSITITINTIIINITITITTIITITVTTITITITIIII

SEQ ID NO: 790345 - protein, 53 aa, Homo sapiens
MHQRSAAGYLSRPGSPSPESWGRIIYLSADRQAGRFAESLGASSSYKGECTTK

SEQ ID NO: 790346 - protein, 178 aa, Homo sapiens
SSLISSPFAHSTHSSGEPPKSYSSTMSLETDSITHLSPSSSGATPTIQPSPSSTDSRMIPSSPQPETITHPSSGSPSAELTPSSHSTLPSSESLTPHWSPTSHSPGTEPLTSTDQTLEPPGPAPGDTGPRELHRNPSVVVVVCLLVSLLLIGSVVMAVRFCHRNESKFENLDEVSMVR

SEQ ID NO: 790347 - protein, 232 aa, Homo sapiens
SSLISSPFAHSTHSSGEPPKSYSSTMSLETDSITHLSPSSSGATPTIQPSPSSTDSRMIPSSPQPETITHPSSGSPSAELTPSSHSTLPSSESLTPHWSPTSHSPGTEPLTSTDQTLEPPGPAPGDTGPRELHRNPSVVVVVCLLVSLLLIGSVVMAVRFCHRNESKFENLDEVSMWFWELVDSGLAPVSPLGGGIIRRGFSGTPLLPSLPSRLVLPGEVEPSTHVVFTIEA

SEQ ID NO: 790348 - protein, 191 aa, Homo sapiens
SSLISSPFAHSTHSSGEPPKSYSSTMSLETDSITHLSPSSSGATPTIQPSPSSTDSRMIPSSPQPETITHPSSGSPSAELTPSSHSTLPSSESLTPHWSPTSHSPGTEPLTSTDQTLEPPGPAPGDTGPRELHRNPSVVVVVCLLVSLLLIGSVVMAVRFCHRNESKFENLDEVSMGSVNDRLSFAHHLQE

SEQ ID NO: 790349 - protein, 96 aa, Homo sapiens
TDSITHLSPSSSGATPTIQPSPSSTDSRMIPSSPQPETITHPSSGSPSAELTPSSHSTLPSSESLTPHWSPTSHSPGTEPLTSTDQTLEPPGPGEY

SEQ ID NO: 790350 - protein, 672 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 790351 - protein, 244 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEVTFLMQNREPLTTLAEFLPELGNSSKPLTRGKKRSS

SEQ ID NO: 790352 - protein, 549 aa, Homo sapiens
NPGPFCSTTCPSSIKLENKGDLSFLSKQAENIKAQQKPQPMKHLLHPTKGEPKWKASLKSEKTVRQLLGELYVDKEYLEKLLLDEDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 790353 - protein, 512 aa, Homo sapiens
MRTHTPLCFNNSKQSKFTEGPAAATGRKQEANPLEACSPGASSHPFPTDLIKGTMKGGLTVEDLIMTGINYLDTHSNFWRQQKPIYARERDRKLMQEKWLRDHKRRPSQTAHYILKSLEDIDMLLTSGSAEGSLQKAEKVLKKVLEWNKEEVPNKDELVGNLYSCIGNAQIELGQMEAALQSHRKDLEIAKEYDLPDAKSRALDNIGRVFARVGKFQQAIDTWEEKIPLAKTTLEKTWLFHEIGRCYLELDQAWQAQNYGEKSQQCAEEEGDIEWQLNASVLVAQAQVKLRDFESAVNNFEKALERAKLVHNNEAQQAIISALDDANKGIIRELRKTNYVENLKEKSEGEASLYEDRIITREKDMRRVRDEPEKVVKQWDHSEDEKETDEDDEAFGEALQSPASGKQSVEAGKARSDLGAVAKGLSGELGTRSGETGRKLLEAGRRESREIYRRPSGELEQRLSGEFSRQEPEELKKLSEVGRREPEELGKTQFGEIGETKKTGNEMEKEYE

SEQ ID NO: 790354 - protein, 238 aa, Homo sapiens
MSDPEGETLRSTFPSYMAEGERLYLCGEFSKAAQSFSNALYLQDGDKNCLVARSKCFLKMGDLERSLKDAEASLQSDPAFCKGILQKAETLYTMGDFEFALVFYHRGYKLRPDREFRVGIQKAQEAINNSVGSPSSIKLENKGDLSFLSKQAENIKAQQKPQPMKHLLHPTKGEPKWKASLKSEKTVRQLLGELYVDKEYLEKLLLDEGFGHFVGTGPWGKGNLGGCFMHELKAEPVI

SEQ ID NO: 790355 - protein, 126 aa, Homo sapiens
PGPPQHTMEAPKGWALARRLGRGWSRKKSFVGPWVRGLSAHQKPPALETKPPRRCGSDPQSLSPTWSWEGGGRCGPGPRTAEGSVGQARTPPGALMVLSLPGRRKAAGTFAWYNHYCSTAQEFGIE

SEQ ID NO: 790356 - protein, 167 aa, Homo sapiens
QTRPLTEFRWGRLGDPPLTRALACRHARAPDTTQEPGGAGRSPWYRPPRPGHLGPGQHPGRTGVWVAGGFPWPLLSPTLSSPLGVAVEGILCAGGARWGGLLSRDPGVPFQKTEHHVLGPDTAHLFQGTARRTRSVPHSQAPAPHKASASRELHLGKYPPSTKETQP

SEQ ID NO: 790357 - protein, 138 aa, Homo sapiens
LSLSTQVWTRYPRAQSPLFLSWGAPLCCSATTGGLICLHHTVATGYRYRYITADTGQRSVCLIALLIGRLTRNLLSPLEPFPWLFQNTGPPTPGLDHTLQVCLRYAGSLQAGCQLYTYWFCNALGAHDLMDPVRAPSL

SEQ ID NO: 790358 - protein, 66 aa, Homo sapiens
TSTMKHGVKNRFIFRTLLNIPCLRGSKYTQHDQCYQQIMQTKLLFRNYKSIMLTVKYLQLRKVYYK

SEQ ID NO: 790359 - protein, 102 aa, Homo sapiens
YRSSSTLFYFLAFWQEVEGLTMPFCFVITQLCSHLGQAMRGRTEKKSNGVGPTFWKPLLHQLERNFQSFGSCGALSTSHCQHHHHHHDHGTSWKLWGQTMKR

SEQ ID NO: 790360 - protein, 168 aa, Homo sapiens
RPPSPTLQHAASEDNLSSSTGEAPSRAVGHHGDGPRPWLRGQKKSLGKKREESLEAKRRKRRSRSFEVTGQGLSHPKTHLLGPHQAERISDHRMPVCRHPAPGIRHLGKVTLPLAKVKLPPSQNTGPGDSSPLAVPPNPGGGSRRATRGPRLPHGTSTHGKDGCSRHN

SEQ ID NO: 790361 - protein, 71 aa, Homo sapiens
CCNIYRSIIGFVKLRSNKVKRSQKLVYMGKLKEKESFGEISVLLQVPFTCTIITKKEVEMAIIEDKDLFVA

SEQ ID NO: 790362 - protein, 148 aa, Homo sapiens
TPENIQLLSTAQPTPASDTTMTGSCCGSTLSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCCRPPCGQPTPCSTTCRTSSC

SEQ ID NO: 790363 - protein, 103 aa, Homo sapiens
DSLEDMALLEDVDLLEDTDFLEDPDFLEAIDLREDKDFLEDMDSLEDLEAIGRCGFSGRHGFFGRRRFSGRPKLSGRLGLLGRRGFSGRCEFEFVFGISGLQI

SEQ ID NO: 790364 - protein, 121 aa, Homo sapiens [sequence omitted]

SEQ ID NO: 790365 - protein, 121 aa, Homo sapiens [sequence omitted]

SEQ ID NO: 790366 - protein, 67 aa, Homo sapiens
MGTTQHSGISLEPKSSDGILLSTVFCGMCYHRRSSPNLSCVQYVSAPRLAEADGIKEPLNTGANTDM

SEQ ID NO: 790367 - protein, 114 aa, Homo sapiens
HTHTHTHIVQALDLASVSFLRDGQQHSFSTISSGSGKKKKKILGRWKRTMGNLFLPCPHLDNNYMGRICQMYYFGTLESIEEGLQLPGKGLDSKLLLILDNFSFYLNSYASPTH

SEQ ID NO: 790368 - protein, 190 aa, Homo sapiens
RLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPR

SEQ ID NO: 790369 - protein, 114 aa, Homo sapiens
ATLSDSEGHATLPACCCCCCTYNPATPNEICPPLLAAFPRLRFSSLFPWVPRARVARTPTLRLRVPAPIAGAPLGTRIPQMTTQTRSCPQVRRAGRPPRPQPTPPEFLRHPQRP

SEQ ID NO: 790370 - protein, 114 aa, Homo sapiens; identical to SEQ ID NO: 790369

SEQ ID NO: 790371 - protein, 130 aa, Homo sapiens
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFADHVVSAVRTSVPLHRSRDETPALAGTDAS

SEQ ID NO: 790372 - protein, 130 aa, Homo sapiens; identical to SEQ ID NO: 790371

SEQ ID NO: 790373 - protein, 607 aa, Homo sapiens
LTSATLAPPTRHMLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 790374 - protein, 138 aa, Homo sapiens
PCQIQFQPFQPGARLAGRERGPSAFPRRPPGNELFRAELGSGQRSSGEMGEDKGLGAFGSVDLAALIVPPFLDHLPSHSRAPGHPTEGLESGQSSRQGLERPAAGRGGQGRGSAAGARPFPGASTLQGSPRAGGPRWK

SEQ ID NO: 790375 - protein, 118 aa, Homo sapiens
RALQKMPARSPILHPARPHGHLHTDPTLHCWTSTQVFHRMPPSFRKGTVLGQVKLSQSGPSCSGAPNLSGSPTLQVQPTLDIVPPCRPSLRGFLRTRPIRPVALTWLSACQVKSFSRQ

SEQ ID NO: 790376 - protein, 92 aa, Homo sapiens
ATPGRLVAGARGGWGYVQSCRGAGTAAVKPLGSAETAVPIARLGCRRFSRSRCCRRRGRGSLLSFSAAKVRSCLGSARGGAPGAARMGQQKK

SEQ ID NO: 790377 - protein, 141 aa, Homo sapiens
ATPGRLVAGARGGWGYVQSCRGAGTAAVKPLGSAETAVPIARLGCRRFSRSRCCRRRGRGSLLSFSAAKVAFFNSAGANAQEEQRVCCQPLAHPVASSQKKPEVAAPAPESGGESVFGETHRALQGAMEKLQRLYGRRRWT

SEQ ID NO: 790378 - protein, 73 aa, Homo sapiens
LNLTTIRIWGYILVAVESVLCTVECLAASLAFTRCMSGAPPALTITKKTLALTGNTSSQTLSDVTWGTKVTSG

SEQ ID NO: 790379 - protein, 114 aa, Homo sapiens
SQTLFCHRTPARGPAGLPGLAAPRGSGRGPALGDKVQGSSPATAEGGRAGCHLAGAPTDSPALPESEPATRASPGTRAGLRARFSRPGQPRARAGKVPATSQGGGGGGSGPRPP

SEQ ID NO: 790380 - protein, 196 aa, Homo sapiens
DVTFANSPAPILPLCWEGVCFSPPALDPLNLLLSEGWGSEAWGGKGLTCPADGVLTCPLLPATPPLPRPWDQTLPTSSPRPTSCHVLYPKVTGMNAWLPLLSSPSSGPSSPADVALSARCLGAYSTLLTGLRPHQPCLELAPPPVITPARLQMSKVLLGSHKLSSSTPSSPGCPSVPHFPSFPSQVQAILLPQPPK

SEQ ID NO: 790381 - protein, 107 aa, Homo sapiens
MRETSANQQPPSWMVAAPPDLLRFITSPAPRLRTCRHRGALTGPAEYSLSCSMPASTCAHLRDMTRTLLGPAPPICKEGPRIQWNIGPFYFQVFLFVFSKIKQIAII

SEQ ID NO: 790382 - protein, 154 aa, Homo sapiens
MALLLSVLRVLLGGFFALVGLAKLSEEISAPVSERMNALFVQFAEVFPLKVFGYQPDPLNYQIAVGFLELLAGLLLVMGPPMLQEISNLFLILLMMGAIFTLAALKESLSTCIPAIVCLGFLLLLNVGQLLAQTKKVVRPTRKKTLSTFKESWK

SEQ ID NO: 790383 - protein, 156 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKYKILNIPFYFTFF

SEQ ID NO: 790384 - protein, 275 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQNPPTAS

SEQ ID NO: 790385 - protein, 723 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTECPVRAVC

SEQ ID NO: 790386 - protein, 723 aa, Homo sapiens; identical to SEQ ID NO: 790385

SEQ ID NO: 790387 - protein, 723 aa, Homo sapiens; identical to SEQ ID NO: 790385

SEQ ID NO: 790388 - protein, 723 aa, Homo sapiens; identical to SEQ ID NO: 790385

SEQ ID NO: 790389 - protein, 457 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKVKRDHERDCI

SEQ ID NO: 790390 - protein, 457 aa, Homo sapiens; identical to SEQ ID NO: 790389

SEQ ID NO: 790391 - protein, 312 aa, Homo sapiens
VALDPISGLSLLLHKILLQSAQILSFIKSNALNSRMLTILCEEMGSEHVSLPLHAEVRWISRGRMLKRLFELRHEIEIFLSQKHSDLAKYFHDEEWVGKLAYLSDIFSLINELNLSLQGTLTTFFNLCNKIDVFKRKLKMWLKRTQENDYDMFPSFSEFSNSSGLNMTDITRIIFEHLEGLSQVFSDCFPPEQDLRSGNLWIIHPFMNHQNNNLTDFEEEKLTELSSDLGLQALFKSVSVTQFWINAKTSYPELHERAMKFLLPFSTVYLCDAAFSALTESKQKNLLGSGPALRLAVTSLIPRIEKLVKEKE

SEQ ID NO: 790392 - protein, 170 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKYKILNIPFYFTFFLVCILFSSNILLIL

SEQ ID NO: 790393 - protein, 457 aa, Homo sapiens; identical to SEQ ID NO: 790389

SEQ ID NO: 790394 - protein, 457 aa, Homo sapiens; identical to SEQ ID NO: 790389

SEQ ID NO: 790395 - protein, 170 aa, Homo sapiens; identical to SEQ ID NO: 790392

SEQ ID NO: 790396 - protein, 103 aa, Homo sapiens
ERNGKERKLITVIGTWKVLSECGLLPCWGLVVSIALPGTGVDPLAPFPALLFTQLKAGLAALSHFCDICQSRPREAGALVSLATQLSLSPHHKSYHAPVSPYP

SEQ ID NO: 790397 - protein, 83 aa, Homo sapiens
IDHRSGKKLEDGPKFLKSGDAAIVGMVPGKPMCVESFSDYPPLGPAVRDMRQTVAVGVIKAVDKKAAGAGKVTKSSQKAQKAK

SEQ ID NO: 790398 - protein, 86 aa, Homo sapiens
CPLERGFVFDECGPPCPRTCFNQHIPLGELAAHCVRPCVPGCQCPAGLVEHEAHCIPPEACPQVLLTGDQPLGARPSPSREPQETP

SEQ ID NO: 790399 - protein, 65 aa, Homo sapiens
MRSHVVSAPGGNRLQLGEERSYQRTTAPGMLRARPVTHFLCGGHSAPPAAGARRLSENHISRHAP

SEQ ID NO: 790400 - protein, 145 aa, Homo sapiens
LFSQNIYYPVDLKNSSEHRKHVSSILCELKPKDLGMKSKTSRHLIQKGQESEDEIVDEKLDTSFRISVFKLPIYTSGSLKNNAVLREKKQHFFPAYPQPIYTTHPKPIIKKDIRLERSMKEFFAPQRADLKKYIKDIVKKNLLWI

SEQ ID NO: 790401 - protein, 173 aa, Homo sapiens
RVRVAVNEHLNQKKYATQKLIEENKETIQNSLRQVWQNRFNYLEKARERKALFLKEKSQKASERLLVQNLNNERTLLTRGLLKIDRLEKNEAVLKEKSLIVKQKLKAEKYRKNLLKEMKKVRSQEIYKRHCEEKFVMDMIAFEKACERLQDAKTKVAIVKTNLDFKVPNGLIK

SEQ ID NO: 790402 - protein, 83 aa, Homo sapiens
RPPVTGRKSNHPKWGFEGKVAFRQAQKGCRLDLPGKGVEVGKYLIVGSVEGVSSVTVWLYCGIHEEGQPEIMATWFGAKFWGT

SEQ ID NO: 790403 - protein, 75 aa, Homo sapiens
EGKEGKKGRKEEREREKEKRKKEKEKERRKEGKKEREERKKKKERKKQRKRKKREMGSDQCWGLDPGLRVKAERV

SEQ ID NO: 790404 - protein, 111 aa, Homo sapiens
MWKKQKVRTEQTRDIVKGDVKTCKWLFETQPMESLYEKVSLMTSSEEIHKGDVKTCTWLFETQPLDTIKDDSETAVKLQTVKQEEIQGGDVRTAIWQISHFQSVFLEQIFL

SEQ ID NO: 790405 - protein, 106 aa, Homo sapiens
ISSWLGLPPASVASWGLTDCELEQLVFLHMDFIFQRGSQSFSHGFQSEGVELCKAMFGNVTTLPLYSMPKESKKSGQIKGFRNRLHLFMRGAGKSHCKAAWAQREE

SEQ ID NO: 790406 - protein, 84 aa, Homo sapiens
VRGGRRKGAPRARLSSNERKQPPATEPRSQALLENRDRLLSLYPHWRFSPAVRLWALPHFLRLKVVEATMILGITTISLQILDP

SEQ ID NO: 790407 - protein, 365 aa, Homo sapiens
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYKLYCKNHSGNDERDEEDEERESKSRGKVEIDQQQLTQQQLNGN

SEQ ID NO: 790408 - protein, 365 aa, Homo sapiens; identical to SEQ ID NO: 790407

SEQ ID NO: 790409 - protein, 311 aa, Homo sapiens
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMVCSFYICYATLHLICCFKFRVHPKFIQSSENLK

SEQ ID NO: 790410 - protein, 112 aa, Homo sapiens
SILPSVDVSAAVQGSPISGVGLGMVTPAGCLEGENQGPREIPGTAFPPSSRAGQTGQVVSGAQVSSWRECQPCSGSPSRILGTDANVGTAGKLSLVPLPGFKNKPNKELSAE

SEQ ID NO: 790411 - protein, 112 aa, Homo sapiens; identical to SEQ ID NO: 790410

SEQ ID NO: 790412 - protein, 112 aa, Homo sapiens; identical to SEQ ID NO: 790410

SEQ ID NO: 790413 - protein, 134 aa, Homo sapiens
FHLSSTFFSVLSLRVQVAISSAQYFLPMEKDFFAPRNFPCLLEGFFFPFIYFLIKRKAVLCNTKVSQIGRKRTSAFTVSIREYFLVEIFSVSRTSVPPLICSHSASNFFQDVLAVLLFGGQCFTLTGSLSSCRK

SEQ ID NO: 790414 - protein, 153 aa, Homo sapiens
LQPGQQSEPLSQKKKRKENVFHIQMQNPLKMSLLRHQPIPHQGIWYLPKGRFCHEPGVRQGPKTPSTCRCDWKANHLYMGTGRERTALGGPHMFLGPAVGYPPTFRHWVLTLFIKTLCVESLPCGWKEVGFLQERMAQCGELVSAWLLSLLKI

SEQ ID NO: 790415 - protein, 121 aa, Homo sapiens
MVEVYQEEKPARHTVGTTMREEVTEGLYCYCSLGSSKYKKVTLSAPPKLRASSLIFLLPGPPSATVVHTEHWSWGPSSHHFTQFDPVQLFWFCLSFFPSSESLAGENNSPYPGTHTAFSHL

SEQ ID NO: 790416 - protein, 42 aa, Homo sapiens
MQQGRISYLMQRCWVMDDFLEKVTAWKDFNFTLSEWRREVRA

SEQ ID NO: 790417 - protein, 87 aa, Homo sapiens
MESPEIDPHKRGHQSFDKEQNKFKGERVVCSKMLLGKAVICVKNQTLTYPSCLVQTSKTPKLLEETIGNPYDLTLGSKIQNFCFKTL

SEQ ID NO: 790418 - protein, 125 aa, Homo sapiens
HPPPTRPRIPKGGEGGEQRGLRPPGAPRRPSAARPLVALEAAPAGTRGQRQDFRRGGSNSRIQRGARAETAAGAEGAPGEACPCRGRGLPQEAGTHASRARQESPAARNLPQGRAERVAGPRSRP

SEQ ID NO: 790419 - protein, 70 aa, Homo sapiens
FLHCPMGPTSWLGHPASSRTKMHFEKVIKVTACPPNAQDNWQTIFGRFTATSVPKINTQQQKGWHLPRYC

SEQ ID NO: 790420 - protein, 98 aa, Homo sapiens
EQCQRQANKVTEITLNNFDKVLEHDGKLTELEQRSDQLLDMSSAFSKTTKTLAQKKCWENIHCQIYLGLVVGGSLLIILIEQLAIFLPQSDTSNAPQT

SEQ ID NO: 790421 - protein, 42 aa, Homo sapiens
MTKALFLLEAFQGSVGSWGRARETTAFLVSPVSAPYPISGEG

SEQ ID NO: 790422 - protein, 120 aa, Homo sapiens
MGTNFPFWVSQLTFFKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 790423 - protein, 57 aa, Homo sapiens
RERSCEVVHTDPKTCQSCSWLQHGGGRVWSPGLFHVGMIQDLGSRNFICESFEGKGP

SEQ ID NO: 790424 - protein, 162 aa, Homo sapiens
MGITPIGLAKEEPSHSDLHRMRAQFLIPKSSPSELEDRGKPLEELAGLARRGPRVLTLSRSSGSARRPRAPPTPFLPGFMGAAGAGNPRGTARSPAPRIPTSPARQRTRIRPPRNPASLYSPAESTQQAVLEDGPARLAEARGARREAPCSSTLGGAPSGSA

SEQ ID NO: 790425 - protein, 146 aa, Homo sapiens
DRARPEGWGPAGDSRCWNAGAYRGENLGGLPAWKPRPSLGLGHSRRSINESKFLPGRRPGLSGESQRGRVLEGSLAAGVRCGLKSEQELGAALGDRLWGTAPREWGKCGPGPLGPPRQQSAGPWEGRCPPAVKGGGPSRVRPSAEA

SEQ ID NO: 790426 - protein, 105 aa, Homo sapiens
MQFPCSKIPHGLLNKPNFVAWYLSPAPAKLSSFVILQEDSCVYSMRKPTQATYWSLHILRKPGNIQLIMFHSRDHSLCLLAHHTTSTLLSCQAPFSPQHGISYPQ

SEQ ID NO: 790427 - protein, 91 aa, Homo sapiens
RKYIEIDSDEEPRGELLSLPDIERLHKKPKSDKETRLATAMAGKTDRKEFVRKKTKVNPFSSSKSKEKKKQKNFMMMWYSQNVWSENKRSF

SEQ ID NO: 790428 - protein, 88 aa, Homo sapiens
CGGGGAGGREGVTRESHCRSSIGPSVVQAEDSGSPPGEHRASQLQEENGARKDDAKFPCTISEPGSHSPGKHLPWCPHGRGVLSGGGL

SEQ ID NO: 790429 - protein, 69 aa, Homo sapiens
MQLGGRLLWDPSPLPPPLPGVNESSVAIRIRCIRSVPLLSPLMTIFLNSESPAPAKGLDKEGAEQEQRI

SEQ ID NO: 790430 - protein, 128 aa, Homo sapiens
MSGRDLPHATVNKGKRQDQNSGSLAASPALLTTGSSCPRMKTIAVRMKAHKMPSESSGYSPSHHLPRQTLRLWPWLCQKLIPCCSPRGPRNCRCARTFLADKCGVAGGLDGVPLCPSAPCVGALMYGV

SEQ ID NO: 790431 - protein, 30 aa, Homo sapiens
MFMHPLELCQAVNLFTPYNVLTLLEKGLKQ

SEQ ID NO: 790432 - protein, 326 aa, Homo sapiens
NLLHRMTEEKTLTAEGLVKLLQAVKTTFPNLGLLLEKLQKSATLPSTTVQPSPDDYGTELLRRYHENLSEIFTDNQILLKMISHMTSLAPGEREVMEKLVKRDSGSGGFNSLISAVLEKQTLSATAIWQLLLVVQETKTCPLDLLMEEIRREPGADAFFRAVTTPEHATLETILRHNQLILEAIQQKIECKLFTSEEEHLAETVKEILSIPSETASPEASLRAVLSRAMEKSVPAIEICHLLCSVHKSFPGLQPVMQELAYIGVLTKEDGEKETWKVSNKFHLEANNKEDEKAAKEDSQPGEQNDQGETGSLPGQQEKEASASPDP

SEQ ID NO: 790433 - protein, 109 aa, Homo sapiens
TPPTPRPTPAAAGGPADRGGADIGPHSRAALRGPHTAPPRASSTSAHCPGSSRNGGHTTRETQTTPLPSCTSFSCNKSPQSRQLQHQKWTFSQLQVQSGFTGHNKGVRC

SEQ ID NO: 790434 - protein, 109 aa, Homo sapiens
VRKTFSYIFLSIKFYTFKFIIRAGHLGSNRDPAAAKPCLSFVCLAWVITAPSLEGYCGDSPLCRECFGPSSSTVRAVSVLLIVAVCVLIMRSESSFSFCLAAWTTVLVS

SEQ ID NO: 790435 - protein, 66 aa, Homo sapiens
CPHMRLSHSTPGSSQRAGSRKSRKEMKGYSRYILPLDTNDQGPVIRSHSPTFEFLLFLLSSVFFSK

SEQ ID NO: 790436 - protein, 513 aa, Homo sapiens
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 790437 - protein, 108 aa, Homo sapiens
MCQSFAYLLFDSFPTLHLQTTFSRLICQLAPAGFKWKTGGPEEAREFPPLPFSACGDISSSGLFFSMIPTPSRQTFPLQSQVLLNTPMQMQFFTCGTTILSLFYQPLS

SEQ ID NO: 790438 - protein, 126 aa, Homo sapiens
CFPSRARERAHARPSRGLSRVPLGPLLTALWRPRGCAARDRASAARGPRPEQLTRQAAPGARPQRQGGSQGPQPRPGPPASAPSHRPRPRASASRAGAAGGIVRAARAWPRRPQARPRAEAAAQAG

SEQ ID NO: 790439 - protein, 153 aa, Homo sapiens [sequence omitted]

SEQ ID NO: 790440 - protein, 76 aa, Homo sapiens
MAVTCCNTYLGTLQFLVSLSFRAPPHSPHPDAGAHSGSHLWHIWSSHSLKGSWHMELPTLPQQPACLAVQWPDPVF

SEQ ID NO: 790441 - protein, 58 aa, Homo sapiens
MLFIVYQCGGTIYFSLRCLMNTMITWTLHVSLGSCDSEAGKLDYLWKLNLEVKGGCRI

SEQ ID NO: 790442 - protein, 72 aa, Homo sapiens
AVGAKPSCPQLPSVSFYAHCAQNLEGARAAGGWCVSTAQLCSEIREGREKLGSRNRHFHACKGKGVSGDLPQ

SEQ ID NO: 790443 - protein, 104 aa, Homo sapiens
WRGQARGDSKSQSPEQREVGPARGAGGGCLDTSLAPGNQDIKAPPEPPCGGVPFIPLKVLLPLGFPEGEPRWDGGAWGSPLAGVSLSGLEGCCCKNNSFDELPY

SEQ ID NO: 790444 - protein, 104 aa, Homo sapiens
RGARIRIPNFEVAVATHTIRTDGTETAAPVSDLLASLPVALSCVLACGDVEGKFDILFNRVQAIQKKSGNFDLLLCVGNFFGSTQDAEWEEYKTGIKKGIEIFL

SEQ ID NO: 790445 - protein, 104 aa, Homo sapiens
RGARIRIPNFRWQSQPVLFGQMAQKPLRLLACGDVEGKFDILFNRVQAIQKKSGNFDLLLCVGNFFGSTQDAEWEEYKTGIKKAPIQTYVLGANNQETVKYFGC

SEQ ID NO: 790446 - protein, 80 aa, Homo sapiens
MSLRKQTPSDFLKQIIGRPVVVKLNSGVDYRGVLACLDGYMNIALEQTEEYVNGQLKNKYGDAFIRGNNVLYISTQKRRM

SEQ ID NO: 790447 - protein, 125 aa, Homo sapiens
EKCPCLGAFGFGWDHPRRPGSWGAWSEGSGSRRRGEPHRCAGRRRGRAQPQVRCPSVQSRCGAAAAAALGRARQPRKGPAVNRLGLREGTAGWRVPAKCRVQALRAWNGWERSDGGRRDRPQRGA

SEQ ID NO: 790448 - protein, 80 aa, Homo sapiens; identical to SEQ ID NO: 790446

SEQ ID NO: 790449 - protein, 103 aa, Homo sapiens
MSLRKQTPSDFLKQIIGRPVVVKLNSGVDYRGVLACLDGYMNIALEQTEEYVNGQLKNKYGDAFIRGNNGNISSPYSTAFKISLSIYNPDSPKRFLDNLKVHF

SEQ ID NO: 790450 - protein, 80 aa, Homo sapiens; identical to SEQ ID NO: 790446

SEQ ID NO: 790451 - protein, 127 aa, Homo sapiens
MPTMWRMLHQALKLRRRTVLAGQEISYVLPVMFVVSEEDSNRDVFLVAGYRHLEFGERIAIWGSSMQHVERRRWPLDSIQKRMGQSFTGWAEEAAPGMKTKKEYAEIGVKPRQNACEMCPGMILSTT

SEQ ID NO: 790452 - protein, 74 aa, Homo sapiens
ATHFADLRSRGRTGESEGARAERGPGTSPVASDLTGNVGAVLKALCLITIESQKQLLGSVKNSTETSKVLGLHI

SEQ ID NO: 790453 - protein, 93 aa, Homo sapiens
LFANQPSNHTRPGPFHSKVTLSDAILPSAQCAERIRSSPLLVLLLVLAAGFWLVQLLRSVCNLFSYWDIQVFYREALHIPPVSWVAVSVQRVP

SEQ ID NO: 790454 - protein, 151 aa, Homo sapiens
LLETAMAPVSESGSGPQGAQIKKGKKKKHSGLDCHVMLFMRLEGSKLADTLLSPMFILLRNWKFFLHHKATCHLLFCTLTSSKLVPTQATAFSFLLPAYDTSLAFQTSFCHFTLQPSKLADTLLSPMFILLRNWKFFLHHQATVTYFFCHL

SEQ ID NO: 790455 - protein, 131 aa, Homo sapiens
LLETAMAPVSESGSGPQGAQIKKGKKKKHSGLDCHVMLFMRLEGSKLADTLLSPMFILLRNWKFFLHHKATCHLLFCTLTSSKLVPTQATAFSFLLPAYDTSLAFQTSFCHFTLQPSMVHTHDQIWMPKSS

SEQ ID NO: 790456 - protein, 67 aa, Homo sapiens
SNLAYTFHIQLLTLLKDTKSILLQANKGELQSSYQKNTPRRIPSNQPKTQKLLAKKKGKRKEIKDCE

SEQ ID NO: 790457 - protein, 123 aa, Homo sapiens
NTFPSLRPAVSTFCKASTTGEWLRLEVPETHTLSMSLLITTKRLELPQPEKARSSSQDGRVGCGPLNLLAHKREVPQITFSSAHSAGWFNRTQKLCMRFFFLIFSMNVFSIIIMKIYNIFVFN

SEQ ID NO: 790458 - protein, 155 aa, Homo sapiens
PRGSMPSWHFGRPVTSYTGLGCPHPSSAEKENCNPSQTDPAWTLRREPGESDQQRNSNLPTYPTLNPPTPIQAPEEEKQTTTEQAIAQELQSEGEVDGNGFSAVPRISSQNTDDKAGDVTHMLSQSAPHPGLVLRSLTRNRQSTLTHSFIIKGVY

SEQ ID NO: 790459 - protein, 120 aa, Homo sapiens
QGLALLPRLECSGAISAHCNLHLLGSSDSPTTASQVLRTTAMSHHAQLIFVFFGRDGVSHVDQPGFELLTSGDPPASTFQNARITGVSHHTQPEVDQSYLSILMNTNEPHQVYPYLPTAY

SEQ ID NO: 790460 - protein, 81 aa, Homo sapiens
MFQSIIYPFSSFFQAFFIHTLTCSLILTQPRRELRQKVQAFVSDNHTNSSASRLQLRLAARLKRLKRQELESIYRPSVRSI

SEQ ID NO: 790461 - protein, 67 aa, Homo sapiens
NKGGRCILEHHLLSAACSCAWETAPAEMSESFGGIEYPVNYLLEQLDSTLHPPAFQEAMEASNDFLH

SEQ ID NO: 790462 - protein, 121 aa, Homo sapiens
KKCVSPSAMIMKPPQPCGTVGSPYVAQAELQLLGSSNAPISVSQSAEITVSLCCPVWSTGMILAYCKLRLPGSSNSSASVSQAAGIIGPRRQGREQEPEPEEVLQDLPISRRQSEPREGWP

SEQ ID NO: 790463 - protein, 114 aa, Homo sapiens
KKCVSPSAMIMKPPQPCGTVGSPYVAQAELQLLGSSNAPISVSQSAEITVSLCCPVWSTGMILAYCKLRLPGSSNSSASVSQAAGIIGPRRQGREQEPEPEEEEDSRRDVLQGV

SEQ ID NO: 790464 - protein, 77 aa, Homo sapiens
ASEVAYPRSPSKQYSNPILHPKLSAAFRKQRQAPWRSRSAAGCGAGRGLRFPSLPQSCWVPGGEACAAPRGGRAKLA

SEQ ID NO: 790465 - protein, 90 aa, Homo sapiens
DVSEKAIKAKENFKFLFQPVSLGKNTTHVNDTTRHTQNRRTRNGHTNEKRNDNETNTHRQMTDTKDETNDTRKKERKKRKKERKKERIPV

SEQ ID NO: 790466 - protein, 72 aa, Homo sapiens
MYICYLFIRSVICWHLLSRNVKGHELIQDLLSSLHLDSSYPPDAGLSDDDEPPNASLPPDPPLLTVPQMHSV

SEQ ID NO: 790467 - protein, 68 aa, Homo sapiens
PGKLRTQSESSMPMGSEPCPGHFTNREMPARRTQHLGLAGHHLPGSAPVGLTAVCLSDIPFSPIFGIQ

SEQ ID NO: 790468 - protein, 440 aa, Homo sapiens
DLDVDLDLHRTLHCWLAMMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 790469 - protein, 145 aa, Homo sapiens
DLDVDLDLHRTLHCWLAMMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFRNQQDRNRQLSKPLLRNTKK

SEQ ID NO: 790470 - protein, 154 aa, Homo sapiens
LFKVCAANFGDICHAVGQEATEKFLIPKFFELCSDAVWGMRKACAECFTAVSHSSSPGVRRTQLFPLFIRLVSDPCRWVHQAAFQSLGPFTSTFANPSRAGLYLREDGALSIWPLTQDLDSGFASGSPAPSSGGNTSPARYALARVTTRTLDVP

SEQ ID NO: 790471 - protein, 112 aa, Homo sapiens
MLVLSSCVAYRSPFPPPPAASTATDHRDVNRQWKALLALQWSTFFRNQYFSILYYPARCVLCRVQVYVTARVRQSFAAAAAAAASRTGCIRKLLSECRNVLLRKQCLPSSFS

SEQ ID NO: 790472 - protein, 68 aa, Homo sapiens
RHSNIWIPHSGSSQEPRSPRTIWALELFSQPPVPRSPFTNLLHTLSPGPMSPQNTDPLLRPHPLTEGP

SEQ ID NO: 790473 - protein, 159 aa, Homo sapiens
GTLCDWSIFLVSETSNAQKIDREISAILKYLKQQCHAQKIGIRDSAWGGTAVHHLMMKYSEFRAGVSVYGIVKDSEDIYNLKNPTLFIFAENDVVIPLKDVSLLTQKLKEHCKVEYQIKTFSGQTHGFVHRKREDCSPADKPYIDEARRNLIEWLNKYM

SEQ ID NO: 790474 - protein, 159 aa, Homo sapiens; identical to SEQ ID NO: 790473

SEQ ID NO: 790475 - protein, 108 aa, Homo sapiens [sequence omitted]

SEQ ID NO: 790476 - protein, 207 aa, Homo sapiens
KWGGNAGEVGADHINILALGWVGVEPQKCSQAHSYQEPMSKIRGLPPEVREPGPGVELGVENGLLCQLIHSPEFNLFSNSVVFESNFIQTHVPEADFQVTKPGNWRDVCEGSATVILGVTSSVPSLPLPNVLLMANVTWPQGPFTTWSTPGDAPVINLSSLKTASCHPPSPASPSCCWRLSRPVAVSHSSQESPSSQQTGTMTLPLK

SEQ ID NO: 790477 - protein, 338 aa, Homo sapiens
KWGGNAGEVGADHINILALGWVGVEPQKCSQAHSYQEPMSKIRGLPPEVREPGPGVELGVENGLLCQLIHSPEFNLFSNSVVFESNFIQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 790478 - protein, 347 aa, Homo sapiens
KWGGNAGEVGADHINILALGWVGVEPQKCSQAHSYQEPMSKIRGLPPEVREPGPGVELGVENGLLCQLIHSPEFNLFSNSVVFESNFIQTHVPEADFQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTPENSLLSSPQPSEPLVLLAAEQTSGSFSQLSGKPQLTADRNNDTAIEIDNCSSYKIPSPVASPINLNIPMRAALSHSLWEQEDWNEHLLQVHIASYLGEHFLGA

SEQ ID NO: 790479 - protein, 252 aa, Homo sapiens
KWGGNAGEVGADHINILALGWVGVEPQKCSQAHSYQEPMSKIRGLPPEVREPGPGVELGVENGLLCQLIHSPEFNLFSNSVVFESNFIQVTKPGNWRDVCEGSATVILGVTSSVPSLPLPNVLLMANVTWPQGPFTTWSTPGDAPVINLSRLLPLKYVELRIYDRLQRILRVRTVTEKIYYLKLHEKHPEIVFQFWVRLVKILQKGLSITTKDPRIKFTHCLVPKMPTNSTETTVSGPPSGTCREISIYKYI

SEQ ID NO: 790480 - protein, 71 aa, Homo sapiens
VVDGKVPDTLRKCFSEGEKVNYEKFRNWLFLNKDAFTFSRWLLSGGVYVTLTDDSDTPTFYQTLAGVTHCK

SEQ ID NO: 790481 - protein, 143 aa, Homo sapiens
VVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGP

SEQ ID NO: 790482 - protein, 151 aa, Homo sapiens
ALVPLGIGIAKENECHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 790483 - protein, 151 aa, Homo sapiens; identical to SEQ ID NO: 790482

SEQ ID NO: 790484 - protein, 151 aa, Homo sapiens; identical to SEQ ID NO: 790482

SEQ ID NO: 790485 - protein, 417 aa, Homo sapiens [sequence omitted]

SEQ ID NO: 790486 - protein, 424 aa, Homo sapiens
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTPRHVSRIFVEDRHRVLYCEVPKAGCSNWKRVLMVLAGLASSTADIQHNTVHYGSALKRLDTFDRQGILHRLSTYTKMLFVREPFERLVSAFRDKFEHPNSYYHPVFGKAILARYRANASREALRTGSGVRFPEFVQYLLDVHRPVGMDIHWDHVSRLCSPCLIDYDFVGKFESMEDDANFFLSLIRAPRNLTFPRFKDRHSQEARTTARIAHQYFAQLSALQRQRTYDFYYMDYLMFNYSKPFADLY

SEQ ID NO: 790487 - protein, 235 aa, Homo sapiens
GAFPARKPDPAVLRGGERTRRRRQQEVGDRSRRGPKRNAAPRPLAPRTLRLPAPRCSPTDRTGFRLERAEAPGPSWVGGPLRRLRAPSRGSAAENRSRTGGARGLGCVRCARSRPDGRLVWTMREERAPHTQEVTPEPAPDDPATWNNAAGLHVLFHPAVRSCRPPPLHQPAGPYGARPPAGARTETSAVSSINGRPPACIAEGGVLLQPRRLEEIWEFKTFTGIDLQSPTHFSG

SEQ ID NO: 790488 - protein, 119 aa, Homo sapiens
STIAVVVYDITNINSFKETDKWVEHVRAERGDDVVIMLLGNKIDLDNKRQVTAEQGEEKSRNLNVMFIETSAKTGYNVKKLFRRVASALLSTRTSPPPKEGTVEIELESFEESGNRSYC

SEQ ID NO: 790489 - protein, 105 aa, Homo sapiens
MSYKTEQGVKLPVALFCHPQPCKMEQFTPSSAGCSLQYSQAPQGEGGAPPEASCCCPQGIKCWVLLTCGCAPSEGHRFVGIGMSTFGRKNKKPENQQIPLCNSLK

SEQ ID NO: 790490 - protein, 67 aa, Homo sapiens
PVPSRDFLKKVTSELSFKAGLGVTQASQSHKGTAGRGDSRSHGVEVENSSGCAFFQITPEHPIPTRL

SEQ ID NO: 790491 - protein, 104 aa, Homo sapiens
VQVCEEGSPVLPWPPLSQMDSARVFSVCACVPVCLFPGEAGCLACLNTHIPQACMCSRRRHPCTVALTPPVTAVVLASRVGGRCPISQLLSVVQKFNCPASQSC

SEQ ID NO: 790492 - protein, 33 aa, Homo sapiens
MVYGWAQWLTPVIPALWEAEAGGSQGQEIKTIL

SEQ ID NO: 790493 - protein, 118 aa, Homo sapiens
VSCFHRIIPGFICQGGDFTCHNGTGGKSICGEKSDDENFILKHTGPGILSVVNAGPNTNGSQFVICTAKTEWLDGKHVVFGKVKEKEGMKIVEAMERFGSRNGKTSKKITIADCRQLQ

SEQ ID NO: 790494 - protein, 133 aa, Homo sapiens
MLFGIRILVNTPSPLVTGLHHYNPSIHRDQGECANQWRKGPGSAHLAGLAGRCSLINTPSPLVTGLQRYNPSMDRAQGMCASLEEEAGLCTPLWAWWELQSHKHSQTSHHRAAGLQSQHAPGSGRVRITGGKV

SEQ ID NO: 790495 - protein, 117 aa, Homo sapiens
MTLFFDSPILKWGKRLEQAPLKGGSPITREPRRSSSPQPSRGHSLVPFRSAVLATTQGSDSPCAGRRCIGNSHTTQSDCAINTDSAFVSVSRRAAPLTLGILECGKSVFLHANEMTG

SEQ ID NO: 790496 - protein, 108 aa, Homo sapiens
MRSLCCAPLLLLLLLPPLLLTPRAGDAAVITGACDKDSQCGGGMCCAVSIWVKSIRICTPMGKLGDSCHPLTRKVPFFGRRMHHTCPCLPGLACLRTSFNRFICLAQK

SEQ ID NO: 790497 - protein, 129 aa, Homo sapiens
MRSLCCAPLLLLLLLPPLLLTPRAGDAAVITGACDKDSQCGGGMCCAVSIWVKSIRICTPMGKLGDSCHPLTRKNNFGNGRQERRKRKRSKRKKEVPFFGRRMHHTCPCLPGLACLRTSFNRFICLAQK

SEQ ID NO: 790498 - protein, 72 aa, Homo sapiens
MPNIHFSVLPTLILPHFLCSPIPQASGPCFRPPFLPQYDSYLLEVKRPLPTPLQGNGTTAFRLPVLNACGRT

SEQ ID NO: 790499 - protein, 120 aa, Homo sapiens
AQAAGSAGAEPRSDWLARPSLSAPGRVESSLHLLRPEPGVRGRSAVLSPIFLGEGEEEIVKGSNNRGQQPCSPKATPSRDSVPSTSSYCLHSAIPPVCTKPEATCLAPWIRGLLQVLGQR

SEQ ID NO: 790500 - protein, 105 aa, Homo sapiens
GIIGMSHHAQPISLVLYPTAPFPCVPTVRPHAPFLLQSQHADPPTVLLPLNPNSSPTPTSHVNLHEILKPQFPPLWHECLKRAYQGNVVRMKLATTRKTLSRCLF

SEQ ID NO: 790501 - protein, 69 aa, Homo sapiens
MFLDCIAGPQREALPMDTEVYESPYADPEEIRPKEVYLDRKLLTLEDKELGSGNFGTVKKGYYQMKKKL

SEQ ID NO: 790502 - protein, 108 aa, Homo sapiens
RDGVLLCYLAGVQWRYLGSLQPPPPKFKQFSCLSLLSSWDYRHAPPRLANFCIFSRDGVSSCWSGWSRTPDLMIRPPRPWYILNSQNDQYIVRVENSGDDKELRLRLS

SEQ ID NO: 790503 - protein, 113 aa, Homo sapiens
AAGITDTRHHTWLIFVFLIETGFRYVDQAGPELLTSGDPPASASQSAGIIGVSHCTQPGGSLISATLCFHVISSQRSQFPRARLFLFHLSALLSLQATSFPHCSSALLPSDSR

SEQ ID NO: 790504 - protein, 68 aa, Homo sapiens
SRRQPEQNWFLPTPEGVLHLPISVEASTMPCAAPSLGTTFTSFSLPPTANPDTSAFKTAMESAPFFFS

SEQ ID NO: 790505 - protein, 106 aa, Homo sapiens
IDSDNGTRFSANIVKGLTQTLGINWEYHTPWHPPSSRKVEKNEPNFKESFKSILKTSLPWTKCLPIALLRIQTAPQKDITYLVYLLFELPLKKTLHTWSIFYFVFS

SEQ ID NO: 790506 - protein, 106 aa, Homo sapiens; identical to SEQ ID NO: 790505

SEQ ID NO: 790507 - protein, 413 aa, Homo sapiens
GACEEAPGPQPLSEIPSRALAPRAPEGPPGRRRPSRGSAFSMNRSHRHGAGSGCLGTMEVKSKFGAEFRRFSLERSKPGKFEEFYGLLQHVHKIPNVDVLVGYADIHGDLLPINNDDNYHKAVSTANPLLRIFIQKKEEADYSAFGTDTLIKKKNVLTNVLRPDNHRKKPHIVISMPQDFRPVSSIIDVDILPETHRRVRLYKYGTEKPLGFYIRDGSSVRVTPHGLEKVPGIFISRLVPGGLAQSTGLLAVNDEVLEVNGIEVSGKSLDQVTDMMIANSRNLIITVRPANQRNNVVRNSRTSGSSGQSTDNSLLGYPQQIEPSFEPEDEDSEEDDIIIEDNGVPQQIPKAVPNTESLESLTQIELSFESGQNGFIPSNEVSLAAIASSSNTEFETHAPDQKLLEEDGTIITL

SEQ ID NO: 790508 - protein, 162 aa, Homo sapiens
HPSLPRPSTQQTRLSRSALDIGTFQKQCQDALFENTVKCFTFHLRYLPWERLSYFSLKENKGQGRGGDHPGPAPHAGRLLRLPDLSRSDTSHTLEDALPPPNAPLAEMRGLYRQCRTGFNVFSHNPLHTTPPFLHLPTSLSADRHHRCFLLSMNPDLSAYLL

SEQ ID NO: 790509 - protein, 280 aa, Homo sapiens
GACEEAPGPQPLSEIPSRALAPRAPEGPPGRRRPSRGSAFSMNRSHRHGAGSGCLGTMEVKSKFGAEFRRFSLERSKPGKFEEFYGLLQHVHKIPNVDVLVGYADIHGDLLPINNDDNYHKAVSTANPLLRIFIQKKDGTFQKQCQDALFENTVKCFTFHLRYLPWERLSYFSLKENKGQGRGGDHPGPAPHAGRLLRLPDLSRSDTSHTLEDALPPPNAPLAEMRGLYRQCRTGFNVFSHNPLHTTPPFLHSPTSLSADRHHRCFLLSMNPDLSAYLLP

SEQ ID NO: 790510 - protein, 52 aa, Homo sapiens
MSSVPRTLPLLTLQMDLLPPNPAPSLPPPSLPTGHLGRVKMAIRTGAAIFTQ

SEQ ID NO: 790511 - protein, 69 aa, Homo sapiens
STTVTGEWEMENQRNVSIAGKFHTEIRYLEKDSLKTDSLYPYILKRPHVPQEVCVSQFEGQYSRTDKNV

SEQ ID NO: 790512 - protein, 97 aa, Homo sapiens
CKFSALALPKESIGTYWWTQNQGAVSLLPGSWLQEALCHISALINYLVECSSLAWAYPIGDIVMYLWAHRLDYMALVFFLGPIHSEDCDISVDPAPT

SEQ ID NO: 790513 - protein, 77 aa, Homo sapiens
RRIIGNFSQVCGTKEICQRGRTLATELDSEVKLDFLSREKREGADSGKARPQVISYQFRLMGPKQKFKLQTRGTNTK

SEQ ID NO: 790514 - protein, 122 aa, Homo sapiens
MGLLGLHRFTLHQPALLPDSPVSVLGTSSCCPPGLEFGNHLQYFSLPVLQLPVCLVLTGPPSLSSLPQCPQRISNSKTYFSSTGLHPGLEQIWNSQFCPQPPPLAPVPSCSPPNTPILLPQF

SEQ ID NO: 790515 - protein, 1156 aa, Homo sapiens
MGNLLSKFRPGCRRRPLPGPGRGAPAPLSRDASPPGRAHSVPTPRPFRGLFRRNARRRPSAASIFVAPKRPCPLPRAAAAPLGVLPAVGWGLAIRKTPMLPARNPPRFGHPSSVRIPPPSRMFTLLLPSPREPAVKARKPIPATLLEETEVWAQEGPRRVKKDEDPVQIEGEDDEKRTPLSSGEASSTSRSQGTQGDVASFRCSPGPLEGNVYHKFSENSMSEKAQASPASSCLEGPAMPSTHSQAGCARHLGKPDPDATAPPEPAVGCSLLQQKLAAEVLNEEPPPSSLGLPIPLMSGKRMPDEKPFCIPPRSAAPPRAARNRPCKRKMSIPLLLPLPPSLPLLWDRGELPPPAKLPCLSVEGDLHTLEKSPEYKRNSRILEDKTETMTNSSITQPAPSFSQPVQTTDSLPLTTYTSQVSAPLPIPDLADLATGPLILPIPPLSTTPKMDEKIAFTIPNSPLALPADLVPILGDQSNEKGGSYNSVVGAAPLTSDPPTPPSSTPSFKPPVTRESPISMCVDSPPPLSFLTLLPVPSTGTSVITSKPMNSTSVISTVTTNASAHLTSQTAVDPEVVNMDTTAPSQVVIFTSSLSSRVSSLPNSQIHCSAEQRHPGKTSVYTSPLPFIFHNTTPSFNQLFGKEATPQPKFEAPDGQPQKASLPSACVFLSLPIIPPPDTSTLVNSASTASSSKPPIETNAMHTTPPSKAVILQSASVSKKYLPFYLGLPGSGNTQPSGNTASVQGSTSLPAQSVRAPATASNHPLNPGATPQPKFGAPDGPQQKTSLPSAHDFLSLPIMVPPDTSTLVSSASAASLSKPAIDTSDMNTTPPSKTVILQSTFVSRKEEYIRFYMGLPGSGNTLHSDSIASAQVSTSFPAQADRRPTTTSSHPLNTGSISHSTLGATDGQQKSDSSFILGNPATPAPVIGLTSPSVQPLSGSIIPPGFAELTSPYTALGTPVNAEPVEGHNASAFPNGTAKTSGFRIATGMPGTGDSTLLVGNTIPGPQVIMGPGTPMDGGSIGFSMSAPGPSSTSGELNIGQGQSGTPSTTSVFPFGQAAWDPTGHSMAAAPQGASNIPVFGYTSAAAYIPGLDPPTQNSCSGMGGDGTRSIVGGPCVPAFQQCILQHTWTERKFYTSSTHYYGQETYVRRHVCFQLP

SEQ ID NO: 790516 - protein, 108 aa, Homo sapiens
GRLITEAFSALRERSSLFAHTRAYFISLSSSFCFVPKILILSFREGAEVNKSTIKAFSEQNGCIILWVSRTQILVSVLNSASSPLERGSNGEKQKQVILLITTLPALF

SEQ ID NO: 790517 - protein, 64 aa, Homo sapiens
MMITRGWEGWGRRGARGAGTGTGLGGPGTPESSVTPPEFPLPPATRITPNFPNTLDPAISRSSS

SEQ ID NO: 790518 - protein, 76 aa, Homo sapiens
IQIHPLCVYMCQILQGRGQTSSKYTHCVCTCVRFCRGGGRPHPNTPTVCVHVSDSAGEGADLIQIRRLCVYTGQQS

SEQ ID NO: 790519 - protein, 87 aa, Homo sapiens
MRSPGYMFASVATRLFPEHKWEAQPPSHCPSYSSLLQDSFLLFKRSEFGQAWWLTAVIPALWEAKAGGSRGQEIKTILANMVKPHLY

SEQ ID NO: 790520 - protein, 152 aa, Homo sapiens [sequence omitted]

SEQ ID NO: 790521 - protein, 88 aa, Homo sapiens
MLPNTQPCGTGCHCYRIQGTGSLKFAMQQMKKKQAVNKDHRVGNNRYYPRCAEKQESRENTQPIHLETVSSLGEKQYFYAAFSYSSGE

SEQ ID NO: 790522 - protein, 155 aa, Homo sapiens
GSRAQGSPGREAGVAVRRALTAAERGLAVPDVQAGGFPAGLPQRQVVLVVSCDPGRAQHRPQIQIQRQEDAQQPDQLQGESTPTRAPPPCRCPPKPFLDAAAARGRQAGPGSQESDLPRGEATEPPRTGTRSLGALRAPCRATKIYGEVNPENLH

SEQ ID NO: 790523 - protein, 104 aa, Homo sapiens
MPGMGGSRSLPLAARVGRGLSEGAQTQTSSAAFFGGPYPLLLQWHFGIYCRHICLLPHLIYKSLTGRRQDPCVFRCTSWAVLTAGKKLTKQELILKTFQRKMCF

SEQ ID NO: 790524 - protein, 38 aa, Homo sapiens
VEGEVCLLPFSKHLCVLQVLQGKLVGGCLSTPRQITPT

SEQ ID NO: 790525 - protein, 717 aa, Homo sapiens
MGDLPPYPERPAQQPPGRRTSQASQRRHSRDQAQALAADPEERQQIPPDAQRNAPGWSQRGSLSQQENLLMPQVFQAEEARLGGMEYPSVNTGFPSEFQPQPYSDESRMQVAELTTSLMLQRLQQGQSSLFQQLDPTFQEPPVNPLGQFNLYQTDQFSEGAQHGPYIRDDPALQFLPSELGFPHYSAQVPEPEPLELAVQNAKAYLLQTSINCDLSLYEHLVNLLTKILNQRPEDPLSVLESLNRTTQWEWFHPKLDTLRDDPEMQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGKKFENIYIGWGHKYSPESFNPALPAPIQQEYPSGPEIMEMSDPTVEEEQALKAAQEQALGATEEEEEGEEEEEGEETDD

SEQ ID NO: 790526 - protein, 114 aa, Homo sapiens
MLNSVWFKCFFIHSELSPNWMCKQAITNSSTNLWVSANHRQPTLQTMFKEGKRQARTHPAVSVPYFCFPYVTLFFLPINHPRPRGSLEASLNLFCFGDCPIQEPFFTQLNSVTF

SEQ ID NO: 790527 - protein, 103 aa, Homo sapiens
GWAEFPRWPRPWLGAPEATRPRLWGALHPRPVRPCGGKCRSETGAIAAPPRDGPASATWKRVSCRRLQSLPAQGAGMRPCGGAGGPRAGLTLLRLCGGEPSDE

SEQ ID NO: 790528 - protein, 122 aa, Homo sapiens
MVVVEKGASLMSRASLMPAQARAPFQRLRDCRGPADSSHAFKLQCFPSHCRRPPWVISRKGRAINKYSICISCVALHLEISFIWQLLQNEPNLEGGLGRFMLASLSLQQVISILAFTRVKQL

SEQ ID NO: 790529 - protein, 108 aa, Homo sapiens
LRRSLHACSHWHSHCMEGNQPRVTQLVSSNIAGLKSKVPGHASMRDRLQGRLILALGSLSWAARITSIVRDPKLCSHLPFPVSAWAMITVTLATLHGHYSTLCHSLLV

SEQ ID NO: 790530 - protein, 128 aa, Homo sapiens
CPSHMQNTLIPIPTVPEVLTQTSINCKSKISCKYRLNQVWVRFEVWFILRQNSSPAVNLYDQTRNYLLPKQDRQSIDISSLKVGHWKEPSYPYGKNQATHTERTKLPYGKNQATIRKEPSYHTERTKL

SEQ ID NO: 790531 - protein, 68 aa, Homo sapiens
QQAWEHHEPAPQSPCDILLTLSPLLKTGSVVLWFPAIYKLCQRAFLLANLCPCCYHRQLLLPFPRCPT

SEQ ID NO: 790532 - protein, 114 aa, Homo sapiens
AADSTRGQAERGMGAQRPLPTRRPRARPPSELHPAPSARAHVPPQPRPVRAHATTRARRRGAREKGSCQGVHYSCGFLDLYRQKPHRLLRSPIFLDKGWEIFLNPDIQHRCCDG

SEQ ID NO: 790533 - protein, 102 aa, Homo sapiens
VLCIMSVIIITLFHQHDHYFHFTDKKNESTQEKVTFQDHKVNGAAEIQSQVVSDPKSPPFTKYGKPLRRAYDTQHFQAYSAREPLHPGPHRGTLGNTALVCS

SEQ ID NO: 790534 - protein, 178 aa, Homo sapiens
RCALRVGSARRPTGGSEELAPSSPPPPRRAGPARPLLPWVGPCSFSGRVYLHRGNCPKWPLWRSWLRRRGRARRSAATRRLTPAPGGPRASGCPACSSRTQPLPQQHRPLGESTRDERAMGPGERAGGGGDAGKGNAAGGGGGGRSATTAGSRAVSALCLLLSVGSAAACLLLGVQAA

SEQ ID NO: 790535 - protein, 82 aa, Homo sapiens
SARLEARGERCSYSSARGGAASRHLRGDQRLPGRGAAGMARPRPREYKAGDLVFAKMKGYPHWPARIGTFGRKSKLSSYLYP

SEQ ID NO: 790536 - protein, 124 aa, Homo sapiens
IILQVIQLVVLPALFLLVQHVYFAGWIRTCGHHLRFFHVNPGTSRCFGLNFGLMAAQIPMILSTDRETSKIKIAFLHPSKMPERLWMAEVTGLPPTSQSVVESVVITLDLCSLSTSVGPKLMKV

SEQ ID NO: 790537 - protein, 102 aa, Homo sapiens
EAESRSVGQAGVQWHDLGSLQPPPPRLKQFCCLSLLSSWDYRRVPPCPANFCVFFLVETEFHHVGQAGLELLTSGSPPASASESAGITDVSHRAQPYLQFSR

SEQ ID NO: 790538 - protein, 132 aa, Homo sapiens [sequence omitted]

SEQ ID NO: 790539 - protein, 130 aa, Homo sapiens
HLVQVTFRGKEDFGKQKAENKNIWGGGGGGGGAGAVAHACNPSTLGGRRRVDHLRSGVQDQPGQHGETPSLLKIQKISRAWWRLLVIPATGELQSLRQENGLNPGGRGCTKPRLHYITLQPGQQEQNSIS

SEQ ID NO: 790540 - protein, 141 aa, Homo sapiens
SLQNPEIQFSGSNLLSPKGNKSTSSWGQSSRAGPLPSCGHHGPEAGRAPRSFSQNSADASQAYAALPGPLTPPTRLALSPSGPGVAAGAEGRLSRRRAPRGSGSPFSKARAKEPQSLARGACHQWSLCSGAAGRAVCAVSL

SEQ ID NO: 790541 - protein, 82 aa, Homo sapiens
KERNYIQIGREEVKLSVFGDNMILYIENPKDSTKGLLELINDFSKVSGYKINVQKSVAFLYMNNVQAENQIKNAILFTVATE

SEQ ID NO: 790542 - protein, 107 aa, Homo sapiens
YSYLIFDKANKNKRWGMDFLFNKWCWDSWLTICRRMNLDPYLSPDTKINSNWIKYLNIRPQTIRILENTILDISLRKEFMAKFSKAITMKTKIEKWGLMKLKSFCMQ

SEQ ID NO: 790543 - protein, 104 aa, Homo sapiens
MGRSPCFFKSFKGKLHKDRSPDPSTLASPHPSTEARRPVEAGSAEWTWGWMKRLPPASLSPGIAMSCYSGDSMLQKYKVKNAYRLHWQGREEPGASTFASLVFQ

SEQ ID NO: 790544 - protein, 143 aa, Homo sapiens
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYEVSIRIPGMSGQDPEGFLLED

SEQ ID NO: 790545 - protein, 754 aa, Homo sapiens
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLRESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQWIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLCVVEVRHGPSSVEMGHELFKLAQIFFNG

SEQ ID NO: 790546 - protein, 754 aa, Homo sapiens; identical to SEQ ID NO: 790545

SEQ ID NO: 790547 - protein, 609 aa, Homo sapiens
MLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLRESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQWIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLCVVEVRHGPSSVEMGHELFKLAQIFFNG

SEQ ID NO: 790548 - protein, 784 aa, Homo sapiens
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLRESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQWIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLCVVEVRHGPSSVEMGHELFKLAQIFFNGFAVPEALSTIQKAEEVLSLHCGPMGTDDNP

SEQ ID NO: 790549 - protein, 415 aa, Homo sapiens
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLRESNNQVKTLNYGLGESVEMGHELFKLAQIFFNG

SEQ ID NO: 790550 - protein, 30 aa, Homo sapiens
MVPRCSTVLMWQRHGILAGQFGGILGTVLE

SEQ ID NO: 790551 - protein, 96 aa, Homo sapiens
VSPSQTCFLYLQLLPEATYKQPCHVATQHWSCHTHAQSYMSTHMHTCAQTCMHIYGRTYTCVHTYTCIYTHTVNTHTHTHTHTHTHRVTHSVLPVC

SEQ ID NO: 790552 - protein, 120 aa, Homo sapiens
GATPPGPRPGADPATPGRPLAPSPTAACARAVTALAPRPRPRDSVTERVPLIRPAWPRPRASRGFQAGPSPVTAGSVAPSPSWAPARPNRHFCRPRSWAWRFGLFSGGSCNSSPSVFEVE

SEQ ID NO: 790553 - protein, 194 aa, Homo sapiens
MPASLLAGVKGAGISEVSWAESPEWEEVAGRGSEEENRGPGGLCFFPDTGAVEETSAADARGASRPRQSWDLGLSCCASIVGALETGGPPEAPVASEDKVWEGREGLQSGMALSSTCSALLMRWNAVSFSRCRSSAVTRYPSSKGGGSIKGSPRLRGSRGILRLRGLESWDLGEPPVGAIVCPGAVSAPFSHRV

SEQ ID NO: 790554 - protein, 194 aa, Homo sapiens; identical to SEQ ID NO: 790553

SEQ ID NO: 790555 - protein, 957 aa, Homo sapiens
ESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVQLAEFLENLQEKSLRIEAFVSEIESFFNTIEENCSKNEKRLEEQNEEMMKKVLAQYDEKAQSFEEVKKKKMEFLHEQMVHFLQSMDTAKDTLETIVREAEELDEAVFLTSYEEINERLLSAMESTASLEKMPAAFSLFEHYDDSSARSDQMLKQVAVPQPPRLEPQEPNSATSTTIAVYWSMNKEDVIDSFQVYCMEEPQDDQEVNELVEEYRLTVKESYCIFEDLEPDRCYQVWVMAVNFTGCSLPSERAIFRTAPSTPVIRAEDCTVCWNTATIRWRPTTPEATETYTLEYCRQHSPEGEGLRSFSGIKGLQLKVNLQPNDNYFFYVRAINAFGTSEQSEAALISTRGTRFLLLRETAHPALHISSSGTVISFGERRRLTEIPSVLGEELPSCGQHYWETTVTDCPAYRLGICSSSAVQAGALGQGETSWYMHCSEPQRYTFFYSGIVSDVHVTERPARVGILLDYNNQRLIFINAESEQLLFIIRHRFNEGVHPAFALEKPGKCTLHLGIEPPDSVRHK

SEQ ID NO: 790556 - protein, 337 aa, Homo sapiens
MGENWAMWKAEKGERHHHLYLIPFGFLTQNTLSDEKLKTESCQAVEDHVLLRSQESKLALLHDCPDSLSAAPSTPVIRAEDCTVCWNTATIRWRPTTPEATETYTLEYCRQHSPEGEGLRSFSGIKGLQLKVNLQPNDNYFFYVRAINAFGTSEQSEAALISTRGTRFLLLRETAHPALHISSSGTVISFGERRRLTEIPSVLGEELPSCGQHYWETTVTDCPAYRLGICSSSAVQAGALGQGETSWYMHCSEPQRYTFFYSGIVSDVHVTERPARVGILLDYNNQRLIFINAESEQLLFIIRHRFNEGVHPAFALEKPGKCTLHLGIEPPDSVRHK

SEQ ID NO: 790557 - protein, 957 aa, Homo sapiens; identical to SEQ ID NO: 790555

SEQ ID NO: 790558 - protein, 326 aa, Homo sapiens
MAEHKMIKKNELVEEYRLTVKESYCIFEDLEPDRCYQVWVMAVNFTGCSLPSERAIFRTAPSTPVIRAEDCTVCWNTATIRWRPTTPEATETYTLEYCRQHSPEGEGLRSFSGIKGLQLKVNLQPNDNYFFYVRAINAFGTSEQSEAALISTRGTRFLLLRETAHPALHISSSGTVISFGERRRLTEIPSVLGEELPSCGQHYWETTVTDCPAYRLGICSSSAVQAGALGQGETSWYMHCSEPQRYTFFYSGIVSDVHVTERPARVGILLDYNNQRLIFINAESEQLLFIIRHRFNEGVHPAFALEKPGKCTLHLGIEPPDSVRHK

SEQ ID NO: 790559 - protein, 337 aa, Homo sapiens; identical to SEQ ID NO: 790556

SEQ ID NO: 790560 - protein, 710 aa, Homo sapiens
ESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVQLAEFLENLQEKSLRIEAFVSEIESFFNTIEENCSKNEKRLEEQNEEMMKKVLAQYDEKAQSFEEVKKKKMEFLHEQMVHFLQSMDTAKDTLETIVREAEELDEAVFLTSYEEINERLLSAMESTASLEKMPAAFSLFEHYDDSSARSDQMLKQVAVPQPPRLEPQEPNSATSTTIAVYWSMNKEDVIDSFQVYCMEEPQDDQEVNELVEEYRLTVKESYCIFEDLEPDRCYQVWVMAVNFTGCSLPSERAIFRTGKEMDAKGALEDNAQFFTDS

SEQ ID NO: 790561 - protein, 137 aa, Homo sapiens
MEFLHEQMVHFLQSMDTAKDTLETIVREAEELDEAVFLTSFEESKMGSNTLRPLWHIYFYSFIFHYSLRLFISLCGIYIILAFKHYLGMPDAYRKGPANPESLNAQIQLKDTAERDSLQHHHPLRPTGFIGHCLRGR

SEQ ID NO: 790562 - protein, 76 aa, Homo sapiens
DLVKFDIVGYGGFGMPLPKLGQEEALYQALKNAYPHLHIYKKEGFPKHFHLAKHDRVLPIVMYANFGYSINGVSSF

SEQ ID NO: 790563 - protein, 71 aa, Homo sapiens
YQGLGGQVKPDAKLTGNTVFQDHAAAVKCRNGPLFEQLLPFYECAYPLCHTHPCTTGDTEDHSLLVTTPNP

SEQ ID NO: 790564 - protein, 179 aa, Homo sapiens
MRLAGRGAERQRTSQCAAGREGYIKLGSRTYWNWSRLPASWQRPSAQLCGVMENAGGAEGTESGAAACAATDGPTRRAGADSGYAGFWRPWVDAGGKKEEETPNHAAEAMPDGPGMTAASGKLYQFRHPVRLFWPKSKCYDYLYQEAEALLKNFPIQATISFYEDSDSEDEIEDLTCEN

SEQ ID NO: 790565 - protein, 186 aa, Homo sapiens
MCSRPRGLYKARVSDLLELVKIARELAAAFRPALRRHGERGRRRGYREWSCGVRGHRRPYAARGRGLRVGFPALLCASQLPPSLPPAPPQLLPSNSPSPTARCQRSASVDSPGSGLTSPLRALCSPIPQIRRLLETLGGRRRQERRGDAEPRRGGDARWPWNDRSLRKALPIQAPSQTILAKIKML

SEQ ID NO: 790566 - protein, 118 aa, Homo sapiens
RPWVDAGGKKEEETPNHAAEAVSEPRVSGRASHGCRRSTRALGTQGLRETCETPGPASRLTSRLPVAIKVPTRRMCPLERWATGTQPGARLLRALGLHSQRARGTLGRARFHFLEGGG

SEQ ID NO: 790567 - protein, 109 aa, Homo sapiens
AGVRTPHVGRESGGILVSDTTRDKRIILRGRVEQAEREKLFECNKEWGFKISFAQRQVLPIGSFPESNLLSLTVGRNAGLLSEERLGFFKGLFFIQVLCEQWLFFFIPF

SEQ ID NO: 790568 - protein, 135 aa, Homo sapiens
HDIQSAPASSASASYDNPVSRWGPQPADSGVPPPKCGGATASSRGQGAPRLLRPPQPTRAARTPTHPTPAGRQGRGVQWGRGPRTRLGSEGGVVAADVGFAAPGQRAAWGTVGLFPAWEGTGAPAREDGRRGTAA

SEQ ID NO: 790569 - protein, 34 aa, Homo sapiens
GNIGFIRQQVIKKAFTCEKKCLVWYTLLKYQMPL

SEQ ID NO: 790570 - protein, 209 aa, Homo sapiens
MMNNFVILNGQLAILLPLRLYFSLFFLLFQAEVIDVSYGMADDLKRIRKIKNVTNQIALLKLGKLPLLYKLSSLEKAGFGGVLLYIDPCDLPKTVNPSHDTFMVSLNPGGDPSTPGYPSVDESFRQSRSNLTSLLVQPISAPLVAKLISSPKARTKNEACSSLELPNNEIRVVSMQVQTVTKLKTVTNVVGFVMGLTSPDRYIIVGSHH

SEQ ID NO: 790571 - protein, 102 aa, Homo sapiens [sequence omitted]

SEQ ID NO: 790572 - protein, 154 aa, Homo sapiens
QDPALNLPLTSLPSCSSPRVEMTAPGLISKWWDKAGTPASSLHTSWEGRSLPSQRQLFPPSQNKCLEGLAEDWDASNLLLLSPGTQLCPAQALPSYEAVVGPLCAVSFGLSPCIVLATYSAKWQSSLVGPPPRSRDCLYFFVCFLKGWGVSHHV

SEQ ID NO: 790573 - protein, 124 aa, Homo sapiens
RAPRSRPSTSDSSPSPRASGCLPLCPSRGDSGEEPPPQRWPGFSRSSLPGCPRQPLGRVQEIPQVAPARMGLTEPERRILKKSCRNSSWGENKETNQQKTGTRAGAGIKPATMAVSAPRAHQLR

SEQ ID NO: 790574 - protein, 102 aa, Homo sapiens
HALATPPPCLRVTGKWEGLWAGDNPAACTLHRESMRRTEEERAGKKQKMQADGSEDRAGSSLNEGLSQPTDSTETVPTQLPCKLGTATPILWAGTQRLRDVK

SEQ ID NO: 790575 - protein, 79 aa, Homo sapiens
IQSYFKNLGNPPQSAVGVPENRDLESMVQVRVDNRKLLQFLEGQQIHPTTALCNIWDNTLLQLVLVQEDVSLQYFIPAL

SEQ ID NO: 790576 - protein, 118 aa, Homo sapiens
RIGSVPKRTLVQNAPPRTAPLCFSGLPRCRAPNFPVVCSFLERYGPLLDLPELPFPDLERVLQGPHRTSATEKSVRKPCSSSGFEGYRKNTRGAGGGSSPKLNHSNEPQHKIPGKGVC

SEQ ID NO: 790577 - protein, 118 aa, Homo sapiens; identical to SEQ ID NO: 790576

SEQ ID NO: 790578 - protein, 132 aa, Homo sapiens
LSSGFWESVGLMVVRSFCTVPRVCLHTSACSPQSSATRPSSSSLSCSQFRHFKSSLSCMWAHWSCPARLSSSSHRCSASACSCCCSCRPQNLVSASHGTGKDGGRLEKSSPLIHSHQSRALAHRSPQKCRFT

SEQ ID NO: 790579 - protein, 124 aa, Homo sapiens
WITPWSRGLCRPSREVFCTQPVGQLPWCPQGAPLSVPTSSLGPHSEDVASDRGWGRYTRVERWTLRASGYDDDDSQTGDSQTGGSLGSSGKAKSPACHIHRLLSQIPGKNLRLSMSGSLMTILC

SEQ ID NO: 790580 - protein, 109 aa, Homo sapiens
GGVSLSHPDECSGVTSVHCNLCLPASRDSPASASQVPEITGACHHTWLIFVFLEKTGFHHVGQTGLELLTSNDPPALASQSAGITGVNHCTWPLFSLSKAYVLSVTRQW

SEQ ID NO: 790581 - protein, 215 aa, Homo sapiens
PGLQEFGTMPAQRERAPVSGTQEKNKIRPRGQRDSSYYWEIEASEVMLSTRIGSSSFGTVYKGKWHGDVAVKILKVVDPTPEQFQAFRNEVAVLQPRHVNILLFMGYMTKDNLAIVTQWCEGSSLYKHLHVQETKFQMFQLIDIARQTAQGMDYLHAKNIIHRDMKSNSIFLHEGLTVQVVTYWLLSSGWPPEVIRMQDYNPFFPVGCLLLWASF

SEQ ID NO: 790582 - protein, 136 aa, Homo sapiens
QGRVRASAWARPGGPGASHDVVQQVGAGHPVERARLGGGHDHAHEGAAGAPVRGVDGGGREAPVGLDELAKLLVDARELVAQEDAAQPQLALDVDEGHLARAPARLAVLIQARRARRWRQDQRLHVGLAAPRRGRP

SEQ ID NO: 790583 - protein, 153 aa, Homo sapiens
SPPSGCICPSHTLMAPKTHLGPILPRLPEHTFKYPLNISRASQAYHGQAELLSHTIHTELPYALTTSPSTLHLSEHSPSHQLPRPKTLQASSAPLLFSCPTSNPETNSFQPTSKKKLGHMPVIPALWEAEAGGSPEVRSSRPAWPTWQNPIST

SEQ ID NO: 790584 - protein, 115 aa, Homo sapiens
ALLPRQPSETGSLSPSALLLLPVHLTLQPPVMFRERCFPAGGWAFNPWPQVPLTRLPGPLTECPPALEPSSQCLPFHPSRGLSPLHLTTTLCCAAVKQQLHEGYPGQATTGWGPA

SEQ ID NO: 790585 - protein, 183 aa, Homo sapiens
SPLLYNVIMSYHHCFWLTVGVYILGILGSTIHTSFMLRLFLCKTNVINHYFCDLFPLLGLSCSSTYINELLVLVLSAFNILMPALTILASYIFIIASILRIHSTEGRSKAFSTCSSHILAVAVFFGSAAFMYLQPSSVSSMDQRKVSSVFYTTIVPMLNPLIYSLRNKDVKLAVKKILHQTAC

SEQ ID NO: 790586 - protein, 102 aa, Homo sapiens
CFGMPGGTVSDMWSPCEPVCAGVREPSALSLCVLHVHDLIPSLSLILASNNLFTADSFGAFVTASGPRTPILPLLLDLISEMDSTSVGAPTGREQSCPETKD

SEQ ID NO: 790587 - protein, 76 aa, Homo sapiens
RGSPWVDRGFWYKRRVQGAKGFQHQRMTNGAMNVEIGNPTYKMYEGGEPDDVGGLLDACLCLDPWPGLGSAALQLA

SEQ ID NO: 790588 - protein, 48 aa, Homo sapiens
MAPPAGRERVAELLFETLAVPACHMASTALLALCSTGAFSGLAVEAGA

SEQ ID NO: 790589 - protein, 90 aa, Homo sapiens
RTRLADTVVLAGGSTLFPGFAERLDKELEAQCRRHGYAALRPHLVAKHGRGMAVWTGGSMVASLHSFQRRWITRAMYQECGSRLLYDVFN

SEQ ID NO: 790590 - protein, 107 aa, Homo sapiens
MCGEPRAGVCPCLFLNLLTWNSLSSPLPLTARQAYLLLLVKALPPKSGLRHPSLRPGPPSCGASLCSSNHQALQAPGPAPFRQPSAPLSLLSSQPSLELLVICMHFP

SEQ ID NO: 790591 - protein, 70 aa, Homo sapiens
AVLATLSLSTVEIPHHHGHQPPGPAVHALSLIPPTLPPSGPIYHNHQTPMPLQATSPTHMWLPLPPSLVS

SEQ ID NO: 790592 - protein, 86 aa, Homo sapiens
ACFAPPTRPGTATKSPTQLFPFPEYPGTLLPSSSSEDSKTVSVPHSSKTTSFSRGGLPDLALLELQERRCTGLTSPAHWRVSEPSV

SEQ ID NO: 790593 - protein, 104 aa, Homo sapiens
APQGSPTSDVVLGMVTPAGCLEGGKQGPREIPGTPFPPSSRAGQRGQALSGAQVSSWRERQPCSGSRGPLHILGRDGNVGTTGMQGLVPLPGIRKKPNKELSAE

SEQ ID NO: 790594 - protein, 110 aa, Homo sapiens
QSGHWAHGGGTAHDPAPREPQAGTTTSKSKCWAPGVPHGWMSKQNMLETHNGILCSLTKEGILTCTTVWLNLGLNLHMGPSESSQTQKPHSVRLHSCTVSRTTSIETESS

SEQ ID NO: 790595 - protein, 45 aa, Homo sapiens
MSNSCSADGRGVEGMNGSQSLWILLPITHLAPVAISPQALWWLRP

SEQ ID NO: 790596 - protein, 71 aa, Homo sapiens
LTENLVWPYNLPGLSLRSSVAPGSDGVERARDLVPHLPEGTGYPLSPAAQPAPRISALRERLTLAAGSLDL

SEQ ID NO: 790597 - protein, 57 aa, Homo sapiens
MKALVPAKDPRFRRWALAAVNKLGVGRRAAPPPSGPPARTPAPGRGRSQSREPGGAE

SEQ ID NO: 790598 - protein, 103 aa, Homo sapiens
LNGKFKQRNNPSIKQRNNLSSSICSKVKKWSPCHKESVTEPGVRSKSLDSKYCALSALIFPVCFTVCLISYLFNTVELISCILVIQVCLLLAIIIFYGLYHKF

SEQ ID NO: 790599 - protein, 143 aa, Homo sapiens
MLVGTTNAGWLRFMPLAWELLQGEDGVWVPGQIPAKSLSQPALDMQISTVAVTGWWIEGKTDLSLIKSEPLTGCVCVYVLVGGGPVPCRTCGCIPDLHLPITKTTKASRLAKCPMGTKLPYIENQCLKQPWTRCAVLLLPAEA

SEQ ID NO: 790600 - protein, 574 aa, Homo sapiens
TWRDAGQDPGGRRTERKGTPGRERRRAGAGGGGGGAGQGGRPGRGRAVALSPSAPPGSQCPLPRALAALPGYFYARTPDTGHRAGAAAAAAEAAEAGPHRGRASGPHVGSRVAGAARAMEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 790601 - protein, 145 aa, Homo sapiens
VFWSLGCRPGARATPVTPARSPDDKLLGRATSTPAGNFEHDPCARHCCRPHMQLLPESSQSPGVGAAGWMPSEAQKDDPNQGHTANYQDRILTPVHTVQSPSFKPSHGEGAAPSPTMLRVPLPPPLPLTSAHDALVKAESCSFFL

SEQ ID NO: 790602 - protein, 103 aa, Homo sapiens
TSPKNANSAAQAVPGNDCRLQGQVIEINSPCPSLNNTQDETQWWGTAASPRLRGWGLSPALHLPWVRAACGQHTSCPPSSSSFRTVSYHIPGTDPGQGGSLQT

SEQ ID NO: 790603 - protein, 122 aa, Homo sapiens
KCCFSFVLKTLLSGTRYTNRAILRTPSMGHKPNTQSRSEDRGCRVALPDILSSAHCTVNSFSARNEDTSLCSGKLHLASPSFCGAGKFSSTKRLYCRWLTICHVPARYHLVSRFCQVLGVKA

SEQ ID NO: 790604 - protein, 82 aa, Homo sapiens
GTVTVAWAALRPTVLSTSPLRLQGAIMVTSCVRMLVGFSGLTGFLMGFICSLAVAPTNCLVALPLLDSAGNNAGIQWGISAM

SEQ ID NO: 790605 - protein, 146 aa, Homo sapiens
RLLCHCAGLSSDTGSHSQIPQHRAEAARCCRRLFKRAFGSSPRLTTNPGRGQTCPLPGPQFPLTYPNRIGLVILGPSTPATVILELVDWYFEESTRQAHWQVISVGIYLLTHSICYLRSVRQVRKQLAPPEALDKAPWGLKGGICF

SEQ ID NO: 790606 - protein, 144 aa, Homo sapiens
MLQHTARRPALPAGARPQDRAVPAPLGAHHPPECPGPGRPERRHEDAEPQSGSHGPHSQITRPLEHVKNTATEEGFSLKRGVGMENASAGGHVRLAREGRGPGWAEGNAGARKGTAGTGLARGAGAHWPLARTGPGALLGTGAA

SEQ ID NO: 790607 - protein, 52 aa, Homo sapiens
MPRGRASRAVRGRVLLGRKARHGPARVLRAQRSLLVWVENCMRLIKDHHPLK

SEQ ID NO: 790608 - protein, 70 aa, Homo sapiens
ARVVCMELLSRSSGLSSDVHPCPQVDTAPPSIWCNSTLLQNGPLPGKAWLAITSLCTFSGFPATIKPLSL

SEQ ID NO: 790609 - protein, 63 aa, Homo sapiens
TLIGHLLSRKPWVKNCFQNLVNFGQARWLMPAIPALWEVKAGGLLDVRSLASWPGQHNGTPFP

SEQ ID NO: 790610 - protein, 93 aa, Homo sapiens
MLSQSLGQEMEESGERRGEITAITTTSSSSTSPRKESRNARRWGQNHEAAEGQKQEAGSKQEAAEAGSSRSRKRQKQAAAGKGERQKQEAGTE

SEQ ID NO: 790611 - protein, 108 aa, Homo sapiens
AVCCAVYLAYKQGFMFRAMEYGVRGLTGKVVAEKEVGEWDMRQVWNVCTEIKKHPFLSMEAGHFVYFLENMKVFQSQHESYIKTSLFCDSGFLLFVQIDSTLLNTNFN

SEQ ID NO: 790612 - protein, 126 aa, Homo sapiens [sequence omitted]

SEQ ID NO: 790613 - protein, 418 aa, Homo sapiens
MYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEVHPHPQEPMQPPVPVPSWPPTSWPWVSLPRHRTGACWERAHLSPVRPQDLWIPYFAITTDITASAMRVHTDGSLWRYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDGEWRRKTKPWRRA

SEQ ID NO: 790614 - protein, 662 aa, Homo sapiens
ATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQADGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWRYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 790615 - protein, 259 aa, Homo sapiens
IRHAGARRAGSAPVPWLCMPVQGVTRAGFSLADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 790616 - protein, 497 aa, Homo sapiens
ATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQADGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWRYVRASMSLSGYMPPLCDPKDGHLLMDGGYINNLPADVARSMGAKVVIAIDVGSRDETDLTNYGDALSGWWLLWKRWNPLATKVKVLNMARDIARGSS

SEQ ID NO: 790617 - protein, 157 aa, Homo sapiens
RVTQPLPFIHLNSQPHLRPEVEPRFASHPTQWEMGMKAACWRGRRTRRAGPLPSMLHPGPCAWAFSQWPPHSRTGHSPGRRLHGCRRPRGPWARQPLSTVARSGVLEPSGCLADKGRSVCPLLVLVEDPRSDVLGQSWSQTEPGVVCRAALGPGGCV

SEQ ID NO: 790618 - protein, 96 aa, Homo sapiens
ATTVHAVRDSELAKLPAGALTSIKRRYPQVVTRLIHLLGEKILGSLQQGPVTGHVLANVCGVWFERELTLVCLLGAAQAQCEGCILRHLQLSDPNT

SEQ ID NO: 790619 - protein, 297 aa, Homo sapiens
ATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQADGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECVL

SEQ ID NO: 790620 - protein, 111 aa, Homo sapiens
LQKPATDIEEPIYTMDKQSSAGGVKRSVPCDSNEANEMMPETPTGDSDPQPAPKKMKTSESSTILVVRYRRNFKRTSPEELLNDHARENRINPLQMEEEEFMEIMVEIPAK

SEQ ID NO: 790621 - protein, 76 aa, Homo sapiens
ERPQWAEGRTAVDTPTPLREAGSGASTMSPCRILPGSQESSCSGRACSDLLTSLCGGREEYLGAHEAQGPLLQKEP

SEQ ID NO: 790622 - protein, 128 aa, Homo sapiens [sequence omitted]

SEQ ID NO: 790623 - protein, 120 aa, Homo sapiens
MWLHLARSPAAEISRQTRVSEPVPARPRCWPLTTSCGWCGGRSEGRGADRGCQKHMKLISATLPRKLVPDRDMWKGICTRKSENICPSKDCLQMCIAVLLIIAPNWKQSKYSSTDGYSVV

SEQ ID NO: 790624 - protein, 43 aa, Homo sapiens
RKTGLGLSSQKEQRKPGTESEGPVSPPEELFVGWLEPTSSTTQ

SEQ ID NO: 790625 - protein, 151 aa, Homo sapiens [sequence omitted]

SEQ ID NO: 790626 - protein, 114 aa, Homo sapiens
FPPTPPALGNNQSTFLRQRFEPLLGGIIVEWKIQFGTWCKLELLSWFFLVPWVGHCRKSIASILSSVLCCTRMAFLPLLQMRKLRLRDIKQGAEWGLSMRPQSLCSCTYIIRPT

SEQ ID NO: 790627 - protein, 103 aa, Homo sapiens
AGTVLLCICLFLFQIPPEQLRIPWVGDKSRQNIERSTLCQAEILHPSCCVILSTSLLILSLGFLFWKMGRGWFTQMPWELRLLAECLAYNRYAVAPVLNQQLD

SEQ ID NO: 790628 - protein, 109 aa, Homo sapiens
ARSSGNECQAEASCRAALCPCQDLTLKTQLEAVNGKTMPALEVFAHALRFFREHALQVRCGPTSADCGRDPLFSPHPKPLPHPVPDIGWVATAGAQRSSSPVPSSLFVW

SEQ ID NO: 790629 - protein, 311 aa, Homo sapiens
MTACVTHSAEYYRHFFLIQSLVVWGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 790630 - protein, 284 aa, Homo sapiens
MGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 790631 - protein, 301 aa, Homo sapiens
MSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLKPFIPLWRMVLYSL

SEQ ID NO: 790632 - protein, 304 aa, Homo sapiens [sequence omitted]

SEQ ID NO: 790633 - protein, 304 aa, Homo sapiens [sequence omitted]

SEQ ID NO: 790634 - protein, 339 aa, Homo sapiens [sequence omitted]

SEQ ID NO: 790635 - protein, 306 aa, Homo sapiens
MAQISSGGGGQSRCLLFALGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 790636 - protein, 315 aa, Homo sapiens [sequence omitted]

SEQ ID NO: 790637 - protein, 311 aa, Homo sapiens; identical to SEQ ID NO: 790629

SEQ ID NO: 790638 - protein, 311 aa, Homo sapiens; identical to SEQ ID NO: 790629

SEQ ID NO: 790639 - protein, 586 aa, Homo sapiens
MEPAAALHFSRPASLLLLLSLCALVSAQVTVVGPTDPILAMVGENTTLRCCLSPEENAEDMEVRWFQSQFSPAVFVYKGGRERTEEQKEEYRGRTTFVSKDSRGSVALIIHNVTAEDNGIYQCYFQEGRSCNEAILHLVVAGLDSEPVIEMRDHEDGGIQLECISGGWYPKPLTVWRDPYGEVVPALKEVSTPDADSLFMVTTAVIIRDKSVRNVSCSINDTLLGQKKESVIFIPESFMPSRSPCVVILPVIMIILMIPIAICIYWINNLQKEKKDSHLMTFNLCLSLAGWRRTFLHAANVVLDQDTGHPYLFVSEDKRSVTLDPSRESIPGNPERFDSQLCVLGQESFASGKHYLEVDVENVIEWTVGICRDNVERKWEVPLLPQNGFWTLEMHKRKYWALTSLKWILSLEEPLCQVGIFLDYEAGDVSFYNMRDRSHIYTFPHSAFSVPVRPFFSLGSYDSQILICSAFTGASGVTVPEEGWTLHRAGTHHSPQNQFPSLTAMETSPGHLSSHCTMPLVEDTPSSPLVTQENIFQLPLSHPLQTSAPVHLLIRCGFSSSFGCNYGMESRHRELVVPQLPARKKV

SEQ ID NO: 790640 - protein, 108 aa, Homo sapiens
MYFVVSASRDLIPIIAALEYNQWFTKLSSKDLKLSTDVCEQILRVVSRSNRLEELVLENAGLRTDFAQKLASALAHNPNSGLHTINLAGNPLEDRGTAEFSLSLMPEL

SEQ ID NO: 790641 - protein, 101 aa, Homo sapiens
RFIRSNPEHILRASNLRNLSMQDQFSKRFRFKSGVRAKSGSWWNLRKVPRHHVRPCAMKPNCRTEKDALLPTQLARPNPAKNTPSGSKITKTSPRSHHPQW

SEQ ID NO: 790642 - protein, 420 aa, Homo sapiens
MEANHSEQLSAERQSTPPGDSSSLPSHNGLEKEDGQDSPTPVQPPEKEASVHPDISEELNRQLEDIINTYGSAASTAGKEGSARASEQPENAESPDNEDGDCEETTEEAGREPVASGEPPTVKEPVSNKEQKLEKKILKGLGKEANLLMQNLNKLQTPEEKFDFLFKKYAELLDEHRTEQKKLKLLQKKQVQIQKEKDQLQGEHSRAILARSKLESLCRELQRHNKTLKEEALQRAREEEEKRKEITSHFQSTLTDIQGQIEQQSERNMKLCQENTELAEKLKSIIDQYELREEHLDKIFKHRELQQKLVDAKLEQAQEMMKEAEERPKREKEYLLNQAAEWKLQAKVLKEQKTVLQAQVRPGGQGMGVLSSLSPNKKAGAKGGHQKSSYVAGDGGMGIGNKEHLPIYSYFQVKIKAPFY

SEQ ID NO: 790643 - protein, 143 aa, Homo sapiens [sequence omitted]

SEQ ID NO: 790644 - protein, 112 aa, Homo sapiens
MTELGRVLEGSTKAKKSYKKKKPTNNNLRAKKIKVSKKEEWSTVNCSRGQVRGMPLILSVRGRVWWLTPVIPVLWVAEAENCLNLGGRHYSKPRSHHCTPAWVNQCETLSQK

SEQ ID NO: 790645 - protein, 143 aa, Homo sapiens
RRRSLCQVSATPSRWVKGCPSPRTHSLGSERTRGARGGVLHLHPGLVSPVPCGNRRRACPPQPPAVVINLRPQSPPGLALREKVWDPPGAALPSGEASEAEHATSLSGPSGPGRQRPHGSGPGWAWPPPDGMYRGNRPAFQSP

SEQ ID NO: 790646 - protein, 122 aa, Homo sapiens
INLPCYPICGVPTIRSDIPAPRIRRISDRTNYGEEGSAYSLLYPTIFARKGVFERDFFKTRSKEEIAEILCNIGVKLSDEEFENVWNLASKKHHRGEVCVENIRNVLDELRHADRIKCKTLM

SEQ ID NO: 790647 - protein, 102 aa, Homo sapiens
PKISVQKHLFEQPLPHSHPTPGRSCFGSCTLWKLLASLFCWVRVGEGLSASPSSLPCSVVGFTFSERLYQMQEMRMKATLEGCKEGRASTVPTVCCLRGLVS

SEQ ID NO: 790648 - protein, 53 aa, Homo sapiens
MLIPLQQYLVSLLPIPVSFLQLQWALFLNNFPTLYFVYDMPFCAYSKTLSKSN

SEQ ID NO: 790649 - protein, 31 aa, Homo sapiens
MLHCAAKPVSERRGANQRAPFRKLPFMARAA

SEQ ID NO: 790650 - protein, 121 aa, Homo sapiens
MDCTPWPQAAVWRDLSSPLPTVTSEHQGRGFLLHLGLFLLPGAALLPPPVTVHPPYPPHPHHERISRAHPPPVPVLSAAFEVTLGWKGCLGYCSDVLAALPPRNTPLLVFRMKLSSNKASF

SEQ ID NO: 790651 - protein, 120 aa, Homo sapiens
ELPTRGQCITRVCGAAVGVTKPTAPVIPEYTPTVTYSTIQYVIIDDKRLLLLCVFAILLRAYSAYLLETKSTVKQPQAGSSGGIQKKAIGVTGDDSSMCVVAPEYLPVGQDVEVEDPDPV

SEQ ID NO: 790652 - protein, 129 aa, Homo sapiens
RGSFGPAWQPEVQSYSAYPAVRRVQPCRSALSTKEISPACQLSPRSSADGCDCLWWGLRQLASRKAPSRAQGFLRGFLLREIWRQMCHMKERMALCKPRRQAWNGPFPLALGRTQPADTLISDFWPPEL

SEQ ID NO: 790653 - protein, 243 aa, Homo sapiens
ELALVFDQAKGAHPSMSQEGQTNLHLLKTNPPVPPSGDTELLSFPVEIQVTAATPIPEQDKESKEVFQTEELEPKAMPQDQVTQSPKHRFVFLSDITNEPPKMLQEMPKHARCREGDSIILECLISGEPQPVVTWFQNGVLLKQNQKFQFEEVNCSHQLYIKDVNSQDSGKYKCVAENNSGAVESVSDLTVEPVTYRENSQFENIGEIYGKYSRDQQLQDQGESVRAHFYDYPAGPFTPWTNV

SEQ ID NO: 790654 - protein, 191 aa, Homo sapiens
ERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATCNNNKLSLSNAISTALPLTQLRWVKQTNTEKKASVVTLPVYLNFTRADLIFTVDFEIATKEDPRSFYERGVAVLCTE

SEQ ID NO: 790655 - protein, 89 aa, Homo sapiens
MHPRSYTHTTHSTRMNTAHTRAQHTHEHTAHTQTHSTCALLIGGCSYQHGFNYLTDTHTHARTHTHTHLVPFGTSTSRGLTTTDLRELP

SEQ ID NO: 790656 - protein, 108 aa, Homo sapiens
GCGPQLSRASLGRTEEQGDTDRSAEAAPPQSAELVLAKLWKEKDSDYLSGAGAGLFCGTAAGPGRIFSSRKAGEAGASRGANPRPRAAAPAPPPRASAAWQGTGWAES

SEQ ID NO: 790657 - protein, 125 aa, Homo sapiens
RTTPFSRVGSPFPSRDRGSSDPLPSLTVHPQDPRPCVWPVPAASPSRPPFAFVASVVEHSRPPFLRTPALPYVVPSCPSLSPSHTMPPRGTHTPLPARRPPAPLPYPRSSMPLPPTPSFCLLFGL

SEQ ID NO: 790658 - protein, 101 aa, Homo sapiens
ETGAEGWRAGGSTRRARPQPEARGSLPSCASALQRSCNARRLHFNVPGSNPGFYSVNLAKSCSFLGLNFLLWQSRGSPRSPSLDLRGLRGTVGLAGVTSRQ

SEQ ID NO: 790659 - protein, 61 aa, Homo sapiens
MDIHLSYQNSLLGLGFWPDFSYNLGTLLWSSPGLSGLESCINLRALPRLIANLGLACPLML

SEQ ID NO: 790660 - protein, 67 aa, Homo sapiens
MVQQSRRLRTEKLGRKGAWAGTAASCRLPVPIRGKMKGRNVDTDSLHLATWERKHHHASLTPGPGSS

SEQ ID NO: 790661 - protein, 593 aa, Homo sapiens
WGRGPWQVHSSANQRPARLVDSVTSPRSPHTPASFLLLPQLHSLVPPHRACWAPLPFHCSAAAWWGHQGQASQGLCLTGLGQCRMGVQAGLFGMLGFLGVALGGSPALRWYRTSCHLTKAVPGNPLGYLSFLAKDAQGLALIHARWDAHRRLQACSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 790662 - protein, 124 aa, Homo sapiens
AHPLSLISNCPLWPLGIQLACFLHQSDLSPPSLCCPLLRLLFHSLDCLGWGGGYGGKGGSCHMSGVQQIVPTYQAQKHTRKAPPLCGRDKAAILFPHANPSFSLPSQTCLFSFFFFWSSAAWNT

SEQ ID NO: 790663 - protein, 142 aa, Homo sapiens
MIDCASLAVYMRHWSPSQAYPPVSPRPRKARPCSQAKSLLSMGDGWPERDTPGLSGVGRGVWRERRVMSYVWGSANCTHIPGTETYKEGTPALWARQSSNPLPTCQPIFFFAFTNVPFFFLLFLVLCSLEYMRKKSGRQEER

SEQ ID NO: 790664 - protein, 103 aa, Homo sapiens [sequence omitted]

SEQ ID NO: 790665 - protein, 136 aa, Homo sapiens
PILFFYFLDRVSLCHPGWSAVTRSWLTATSASWVQSDSPASASRIAGITGVRHHTRLIFVFLVESGFHCVSQAGLELLTSSDLPTLASQSAGITGVSHHTWPESSFRYVGLRYLLDFQLEILAVWLYRSAKMLWSI

SEQ ID NO: 790666 - protein, 104 aa, Homo sapiens
QRGGAWSLLFLGGTWSSICQAGSTLGGTLALWRVPVSFFFFHPINPALFTLQIVCQPSFLWSCDKDPVLSSTKEKVAQHYYLVQCLPFKKNKNKTRKKASETQC

SEQ ID NO: 790667 - protein, 106 aa, Homo sapiens
LFADSAPKSSSFPECSACAPSPACLLIGSCSHVHTCCVTLTLPLLPTSFPQLPSITTCSITQASLRRVADLFLFGHWPSLEQVALTCSTGWMWFLCFERVPAWATW

SEQ ID NO: 790668 - protein, 135 aa, Homo sapiens
SPSSGTEWQRAWEPQEPPGLDPFPATVIALPRALQTPGWEGAGERTRGNPKNIHFLFPREPGSGQVGTLGKGAEWGNGKEFLGNFTTPPPPPPAPPHPPHPTRRDPADPCPAGTRFLASELLSEATERSRLAAGT

SEQ ID NO: 790669 - protein, 138 aa, Homo sapiens
SKSSPSSWGDSLCTHAGIGWLTDGTICLPSSLLLELKYPGLGNKKGFLEEEKLELGFRRPSVSDWKGPWRSFIPAVFKFCSLRTLSSKKLCVEKQYIKQFFIIETYFLLQVAHEKWSRNRKETWELWKRQKAIGRYGR

SEQ ID NO: 790670 - protein, 117 aa, Homo sapiens
KEQFTGGWRGHCEEGTLTSPCAHEGIQILNEGDPRRAMTFPWVSNPSISSMVVAERNYAQCRECPSYESYSQQLFLTIKWVILMEEGKICSIKVSRQTVQKLHFQTSLVNVVKPRLY

SEQ ID NO: 790671 - protein, 271 aa, Homo sapiens
MRAPMLQKQQAPRMDTPPPEERLEKQNEKLNNQEEETEFKELDGLREALANLRGLSEEERSEKAMLRSRIEEQSQLICILKRRSDEALERCQILELLNAELEEKMMQEAEKLKAQGEYSRKLEERFMTLAANHELMLRFKDEYKSENIKLREENEKLRLENSSLFSQALKDEEAKVLQLTVRCEALTGELETLKERCAQDACQAQAREKELLELQSQQACTHTKETEQLRSQLQTLKQQHQQAVEQIAKAEETHSSLSQELQARLQTVTRE

SEQ ID NO: 790672 - protein, 145 aa, Homo sapiens
MALLCYNRSCGQRFDPETNSDDACTYHPGVPVFHDALKGWSCCKRRTTDFSDFLSIVGCTKGRHNSEKPPEPVKPEVKTTEKKELSELKPKFQEHIQAPKTVDAIKRPSPDEPMTNLELKISASLKQALDKLKLSSGNEENKKRR

SEQ ID NO: 790673 - protein, 72 aa, Homo sapiens
SLLPTSGTLTSPQRPPGRPAFLSPSARGFPSVSPGARCSLTLLGLVSPDLQLVFDFPSGKRLQFQGKPRAKV

SEQ ID NO: 790674 - protein, 105 aa, Homo sapiens
MTKGKENPHQGKNTVQGSEAQIPGRGVKVVCRTWVKGWGWRVGEEATQVRRCQITKGLVCQTKKTELDHEVRQTLWRVLKQGVVWMNKPVMGWGYQGGLPGGGQT

SEQ ID NO: 790675 - protein, 1009 aa, Homo sapiens
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVIITKFIVKDSVEENMLKIQNKKRELAAGAFGTKKPNADEMKQAKINEIRTLIDL

SEQ ID NO: 790676 - protein, 1009 aa, Homo sapiens; identical to SEQ ID NO: 790675

SEQ ID NO: 790677 - protein, 1009 aa, Homo sapiens; identical to SEQ ID NO: 790675

SEQ ID NO: 790678 - protein, 1009 aa, Homo sapiens; identical to SEQ ID NO: 790675

SEQ ID NO: 790679 - protein, 991 aa, Homo sapiens
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVTHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNIKSLVVSQFTTFLSLIEIPLKASGFVFTRLDGSMAQKKRVESIQCFQNTEAGSPTIMLLSLKAGGVGLNLSAASRVFLMDPAWNPAAEDQCFDRCHRLGQKQEVIITKFIVKDSVEENMLKIQNKKRELAAGAFGTKKPNADEMKQAKINEIRTLIDL

SEQ ID NO: 790680 - protein, 870 aa, Homo sapiens
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLGKTLTAIAVILTNFHDGRPLPIERVKKNLLKKEYNVNDDSMKLGGNNTSEKADGLSKDASRCSEQPSISDIKEKSKFRMSELSSSRPKRRKTAVQYIESSDSEEIETSELPQKMKGKLKNVQSETKGRAKAGSSKVIEDVAFACALTSSVPTTKKKMLKKGACAVEGSKKTDVEERPRTTLIICPLSVLSNWIDQFGQHIKSDVHLNFYVYYGPDRIREPALLSKQDIVLTTYNILTHDYGTKGDSPLHSIRWLRVILDEGHAIRNPNAQQTKAVLDLESERRWVLTGTPIQNSLKDLWSLLSFLKLKPFIDREWWHRTIQRPVTMGDEGGLRRLQSLIKNITLRRTKTSKIKGKPVLELPERKVFIQHITLSDEERKIYQSVKNEGRATIGRYFNEGTVLAHYADVLGLLLRLRQICCHTYLLTNAVSSNGPSGNDTPEELRKKLIRKMKLILSSGSDEECAICLDSLTVPVITHCAHVFCKPCICQVIQNEQPHAKCPLCRNDIHEDNLLECPPEELARDSEKKSDMEWTSSSKINALMHALTDLRKKNPNSLWICVYSFGWFHGPKEKS

SEQ ID NO: 790681 - protein, 1009 aa, Homo sapiens; identical to SEQ ID NO: 790675

SEQ ID NO: 790682 - protein, 1009 aa, Homo sapiens; identical to SEQ ID NO: 790675

SEQ ID NO: 790683 - protein, 88 aa, Homo sapiens
GQEVGETEGTETECAGRHRKGDTERVKSTSERTLAKNYPKWLKDTRENMLKIQNKKRELAAGAFGTKKPNADEMKQAKINEIRTLIDL

SEQ ID NO: 790684 - protein, 305 aa, Homo sapiens
MSWMFKRDPVWKYLQTVQYGVHGNFPRLSYPTFFPRFEFQDVIPPDDFLTSDEEVDSVLFGSLRGHVVGLRYYTGVVNNNEMVALQRDPNNPYDKNAIKVNNVNGNQVGHLKKELAGALAYIMDNKLAQIEGVVPFGANNAFTMPLHMTFWGKEENRKAVSDQLKKHGFKLGPAPKTLGFNLESGWGSGRAGPSYSMPVHAAVQMTTEQLKTEFDKLFEDLKEDDKTHEMEPAEAIETPLLPHQKQALAWMVSRENSKELPPFWEQRNDLYYNTITNFSEKDRPENVHGGILADDMGLVIIFFFS

SEQ ID NO: 790685 - protein, 203 aa, Homo sapiens
QFDLDSIWTFIFGVPASSGTVVSSIHNVCTEAVFLLLGMLRSMLTSPWQSEEEGSWLREYPVTLMQFFRYLYHNVPDLASMWMSPDFLCALAATVFPFNIRPYSEMVTDLDDEVGSPAEEFKAFAADTGMNRSQSEYCNVGTKTYLTNHPAKKFVFDFMRVLIIDNLCLTPASKQTPLIDLLLEVKKKKRIYISFALLFKLEH

SEQ ID NO: 790686 - protein, 175 aa, Homo sapiens
AVCFSASGSRVAWVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTHLALDGGMKYFWECERELGESQPLEGAFTDHNDL

SEQ ID NO: 790687 - protein, 64 aa, Homo sapiens
MICLFVSFVVLLNHFSYSFLCSLYTLDTNSLLAICIANIFSQSVAYFKILFVVSFCLAKVLILK

SEQ ID NO: 790688 - protein, 121 aa, Homo sapiens
LRLPVSSNSCASASRVAGITSVHHIWLIFVFLVEIGFHHVGQACLEFLASSDLPASASQSAGITGVSHRAWPFGLQNLTIMGSKLSGGITSGAAEQDYRKGIIKYSEVCLCKQTQMSTLEE

SEQ ID NO: 790689 - protein, 368 aa, Homo sapiens
ARCTVDDESGLGAPGRGRAGRQSWVRARASGARRDSEMQAARMAASLGRQLLRLGGGSSRLTALLGQPRPGPARRPYAGGAAQESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNVGLADIFTVFAKTAVTDPATGAVKEKITAFVVAEGLRGHLMGPWEKWAQRQQSEGVLGEQGIREHAGGGQAQGREPTQRWKWPRRRKPYTDRHTARNTGTH

SEQ ID NO: 790690 - protein, 392 aa, Homo sapiens
ARCTVDDESGLGAPGRGRAGRQSWVRARASGARRDSEMQAARMAASLGRQLLRLGGGSSRLTALLGQPRPGPARRPYAGGAAQLALDKSDSHPSDALTRKKKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNVGLADIFTVFAKTAVTESSTGAVKEKITAFVVERGFGGTPWAPGRNGPSVNKAEGVLGEQGIREHAGGGQAQGREPTQRWKWPRRRKPYTDRHTARNTGTH

SEQ ID NO: 790691 - protein, 129 aa, Homo sapiens
RKIHPSAPVRGLPPALPIRGQRPQACRSVPLHSGSRRPWARGLGVGNPAPWSALESLSFPSPVLSSHWCPVRRWDYPFSIPLSNAGSIQQLQVALQPTLPPSSASASTLPFILPFIHSSFSPRPSFIHS

SEQ ID NO: 790692 - protein, 218 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIDTRRAGCC

SEQ ID NO: 790693 - protein, 253 aa, Homo sapiens
KAFRALLLKKRRTESRPLPNKLNANQGGFENGEIGESEENNPLDVHSIYIVPFQCPKCEKCFESEQILNEHSCFAARSGKIPSRFKRSYNYKTIVKKILAKLKRARSKKLDNFQSEKKVFKKSFLRNCDLISGEQSSEQTQRTFVGSLGKHGTYKTIGNRKKKTLTLPFSWQNMGKNLKGILTTENILSIDNSVNKKDLSICGSSGEEFFNNCEVLQCGFSVPRENIRTRHKICPCDKCEKVFPSISKLKRHY

SEQ ID NO: 790694 - protein, 205 aa, Homo sapiens
KAFRALLLKKRRTESRPLPNKLNANQGGFENGEIGESEENNPLDVHSIYIVPFQCPKCEKCFESEQILNEHSCFAARSGKIPSRFKRSYNYKTIVKKILAKLKRARSKKLDNFQSEKKVFKKSFLRNCDLISGEQSSEQTQRTFVGSLGKHGTYKTIGNRKKKTLTLPFSWQNMGKNLKGILTTENILSIDNSVNKKDLSIWGSP

SEQ ID NO: 790695 - protein, 134 aa, Homo sapiens [sequence omitted]

SEQ ID NO: 790696 - protein, 68 aa, Homo sapiens
QERAAAQEHLKKEAVIRIRNHQEVRMRRGKILTSAGAQKLGWSELRSDGCEEVETACVDIFSRLHGCG

SEQ ID NO: 790697 - protein, 108 aa, Homo sapiens [sequence omitted]

SEQ ID NO: 790698 - protein, 70 aa, Homo sapiens
PNKLGHSQLNCLFLRVFKDNNPYRKYHHFRESANYNNPTAVPRHSRQHRSRFMFHPNGLFTPWKAPTKDS

SEQ ID NO: 790699 - protein, 119 aa, Homo sapiens [sequence omitted]

SEQ ID NO: 790700 - protein, 67 aa, Homo sapiens
ERGVTCSTTPTQMEGTFSVVLATPSVVKVPGLEVGYVFLGSSLQYLKPQTCNLKLPSATIPVNLWKT

SEQ ID NO: 790701 - protein, 110 aa, Homo sapiens
MLVWGRGPHCIATCAKGGPRETWVLTYALCFSPPKKNAGGTAGGLGTKPDRVSGGLHGFSTSGCQRLRNKAPGGGEEKLTDRTNDEEQTSKDEAHDKRHDHKTTTKQERT

SEQ ID NO: 790702 - protein, 113 aa, Homo sapiens
MNQDQGGRTGHKAQLCSLLHSDFPQEPQLRTEKGDSPLSAHLSTCCPSLPLSKHHSRERTPCPRPSQPPSKEPQWSPHGLGTRLMFCREATRHSHAPGFTGPDILGHVSVWRP

SEQ ID NO: 790703 - protein, 118 aa, Homo sapiens
MGACLRAGFLIEGFGSLLIIYPLVGFISKVQQYRTCPLGSLLGFFLPHNIFSHVFMRGKSFLLVELIVDQATCVGLLCPGKRGFTESGGHPPPRLGSIEHLKNTENLDPVGINKRSLG

SEQ ID NO: 790704 - protein, 145 aa, Homo sapiens
APCLPQYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALM

SEQ ID NO: 790705 - protein, 116 aa, Homo sapiens
GDRGGPGIPGFKGEPGLSIRGPKGVQGPRGPVGAPGLKGDGYPGVPGPRGLPGPPGPMGLRGVGDTGAKTLNTSHGLEDPSCPDCSFCHFSLAADIQPKWPALLQLIPASGTRQDG

SEQ ID NO: 790706 - protein, 118 aa, Homo sapiens
GDRGGPGIPGFKGEPGLSIRGPKGVQGPRGPVGAPGLKGDGYPGVPGPRGLPGPPGPMGLRGVGDTGAKGEPGVRGPPGPSGPRGVGTQGPKGDTGQKGLPGPPGPPGYGSQGIKVSE

SEQ ID NO: 790707 - protein, 104 aa, Homo sapiens
FSLIERNVHGALFVYWQIYDEKRKYQANHHGHISEKRDTSLRRVPGRSFMGISEEGIAIIGDDSSVHVTAREDLPVGQDVKVEDDDIDDSDLCMPRLMYLCLSF

SEQ ID NO: 790708 - protein, 230 aa, Homo sapiens
GDYVGLELTAVLTRPRAASRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVSERER

SEQ ID NO: 790709 - protein, 276 aa, Homo sapiens
GDYVGLELTAVLTRPRAASRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQVSRPMSKCQAEARRLRARGFPPGSCLCLYPKSFLELEAPPL

SEQ ID NO: 790710 - protein, 256 aa, Homo sapiens
GDYVGLELTAVLTRPRAASRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVYNPRIRAEFQCRANVGGTTRIVICLLPGVKT

SEQ ID NO: 790711 - protein, 249 aa, Homo sapiens
GDYVGLELTAVLTRPRAASRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEVKNKTKQKKQPAEMSLQKEEISLCCESLSREVESLLLQGLPPRVLPLHPDCGRAVQAVYEDMDARKVVVTHWLADFSFSLPSIQHVIDSGLELRSVSERER

SEQ ID NO: 790712 - protein, 119 aa, Homo sapiens
PFPLSSLDGGRCGSNPAGSQRVSMYLGLQGHRWGEEGWRGWRGKWKTPSTFHNFIFLNKCFESFLKVRKFCLPVSFRRALISVVTNVAPGPPAKYTLRRGSLGGQGGRITRSGDRDHPG

SEQ ID NO: 790713 - protein, 168 aa, Homo sapiens
SPAATVSHPAPKASPVPAAPPPCPAASPSPAASPAPLATSPVLTASPPLPAASPTLAAFPVHTASPPIHIASPPVHIASPSVHVASPPVHVASPPVHVASPSVSCSGDSTSDCFPPQPGAVFPHSPAPSLGGWSHLVAAPPQRALLGALGPGVQLRKEADNKGLWTLK

SEQ ID NO: 790714 - protein, 103 aa, Homo sapiens
RVGPVDSGRPWVVNHPGLPTSDRFLGHRIFHAKTRTVPGNLDGHPSGADAELWFSVQLLSVSQFPHLELRAYNSTLCMVAGRWGRVTLNNVLKVLSIRHSMSI

SEQ ID NO: 790715 - protein, 121 aa, Homo sapiens
PLAADSPSYPVPLSGWVTVTSNVTIDVTLTFLPFPEWSGNWDGGRHTLPGQQHALRGQSKEAFLTVVTLTSLDLSIPQLSFGALYNTSLVIIMSQGQEIKGVGEYVTLFKEKAREMLVDLK

SEQ ID NO: 790716 - protein, 133 aa, Homo sapiens
KVGGSGPARTGRGGAGAVPAAEAPKAFARPLAAAAGAGWTRRAGSRMRMNPSVLECPEALRLSFPPRGKGVRGDPDIQGPEVSASRSWAGDWAGCAGSQRGDSSGGRPGCWGLRAADKAAAPPRGAGQWNEWA

SEQ ID NO: 790717 - protein, 91 aa, Homo sapiens
VKGTFYVVAARENEEVQKRKPLIKPSDLVRLIHYHENSMREIAPLIQIISHRVPPIECGNYGSTIQDEIWVETQRQTVSRTLSENLTMLTS

SEQ ID NO: 790718 - protein, 112 aa, Homo sapiens
ACGSLEAAGQGGAWKPEILPAGPNALSTTTAADECLAAHLSPRGPAEPPGCIPWPATERTPPHPHFPGEEPGLWDLRRGLQVRTVATRDLAAADALWEACVQPFVLPGAGTY

SEQ ID NO: 790719 - protein, 136 aa, Homo sapiens
DPNVVSISFLRDLIQTGLPMIMEKTLNSERTDGQVMNQLGQPVCQPTAAHLLLLASPPITLPDVAEMLWEIIQVYQTDFLSMVRKFLKGLPKENNRGSLSPVTPPTTYELPTSQVTSAEECKQVCWALRDFTRLFR

SEQ ID NO: 790720 - protein, 150 aa, Homo sapiens
VEASRGRACLGWLHLGPQLEQGNGVQEPVPLRRGTYRHADPNRPTHFRFTSPWGEEQRDRITCQRSPGKEKLSLQTGPAEGANCCPCSVTPSTQSPSDKKKEKLGLTIPEFTAGRCQPCFLSLSTTATSITNNIYQFLQILVKKSYSKRF

SEQ ID NO: 790721 - protein, 117 aa, Homo sapiens
TEPNSVSKNNNKRKINCLFSFLCPSFCSLQYRQGSVTENIGVNPGEGVLVALTQIQTPLSAHIQTTELEIEKGPPSASSPVLSSVDAPGHLWLWSTGVWLGQIQMGCKCKNTLVSKT

SEQ ID NO: 790722 - protein, 71 aa, Homo sapiens
RKAKLRRKSIDPWRTLTWHWYFGSQDCPTGRPPNSEPDPMSCIDYEYTEGAFTEAVLLFWVYKCHQNGRPS

SEQ ID NO: 790723 - protein, 44 aa, Homo sapiens
MAAGLMHWDGTSSFFLRQSFTLSPRLEFSGMISAHCNLYLPGSS

SEQ ID NO: 790724 - protein, 94 aa, Homo sapiens
MCTGALRVRYTACSIVWIHLTAQDRSIRSLFWHLLDWGEQRARQQARGRRQKETPRRGEAQGLREADSSLQKSLPSKAPVLWAGRGGCKLRRGH

SEQ ID NO: 790725 - protein, 150 aa, Homo sapiens
SIYANEGLKLLSSDWPAQLSSDWPMPLSPDWLIEPSSDCLVLVYSGKASMLKNICPGILHGLREKKAYLSLCIQTLICKLWEKYKNKPDMNYEARGCALRSYYHREILAKAEGQRLVYQCKDMPSNRLVIDNDKRQTCNEGLAAASDASH

SEQ ID NO: 790726 - protein, 101 aa, Homo sapiens
GNARHISSIPRPQRLRLSMVRRLMRGTRELRPSRREQSPASCRARTAWAAWLAESPVQFMHMHTCSLHRCVQQNVCVNHLNHPQICILITLVQGPGQRRLK

SEQ ID NO: 790727 - protein, 236 aa, Homo sapiens
LVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNLLPYNVMLYSDAPVSELSLELLLLQVVLPSITRTGTHEAVAEGAGASVDCDRRILAGSSFLYWETRKKMKTVQINKLTIISKL

SEQ ID NO: 790728 - protein, 139 aa, Homo sapiens
AEIAPLHSSLGDRVRLCLKKEKKKSTHEHVFPHIGAHFTTTDNKHKFRVVSFKSVSYILQESSLWQGLSFASHLYSSSTSGSSALKPPAVALPPHAKFMTASRVHVFAPVRNTSHGPGPESQASQNPWQQRIPPLPLGP

SEQ ID NO: 790729 - protein, 71 aa, Homo sapiens
LMIITVSPPPPIYKQPIKTHFGEFDILFIKSDGWARWFTPVIPALWEAQVGGSQGQEIETILANMGKPCLY

SEQ ID NO: 790730 - protein, 60 aa, Homo sapiens
MLNILSITEFKSITIKTLVPHLTSPIPRTQQPNATTTRMVQLQAELWPLTSAQLNSMSTN

SEQ ID NO: 790731 - protein, 77 aa, Homo sapiens
RQVPNMSREKCSPGEGAEEGRGSEASGLKASAGNRRAQEDSGASPGTGGAQALGPHGRPKHKTVCPLESQRDPCAMN

SEQ ID NO: 790732 - protein, 109 aa, Homo sapiens
KNVSFNLRAPGLGQSPQNTWGHMTPVPQELPGRRGGHLPAPLAPTEKPAWVALRGQTESLGTSSPTIPLKESWGRGRLLGFGLQDLALDRCQMFAGYMRHLFLQKGNCT

SEQ ID NO: 790733 - protein, 107 aa, Homo sapiens
PSPPGPAPLPQVHPFPNQPRQVTAPWPKARLPGQQRKIKFHFAHCLPPRAPLFEERGALSFLAPSHIWELCRQRTHTNGLAPFPNRDSRAIHSTSLSDLIKQKLKNE

SEQ ID NO: 790734 - protein, 77 aa, Homo sapiens
LSDLNNRNVFLTVPEAKKSKITVPAWLVSGAASLPGLQMAAFSPCPLMAEKVCELSGFRSYKDTNPIEPGPYPHNII

SEQ ID NO: 790735 - protein, 198 aa, Homo sapiens
TSSCRIGTSEKSNDKKLLEMTINMLNVFGNEDFDCHGDLKTDQLKMDILIKKLKQKEQAQYEKQLEQLNKDNMASLNKKELTLKDVECKFSEMKTAYEEVTTELEEYKEAFAAALKANNSMSKKLTKSNKKIAVISMKLLMEKEQMKYFLSALPTRRDPESPCVENLTSIGLNRKYIPQTPIRIPISSPQTSNNCKNS

SEQ ID NO: 790736 - protein, 127 aa, Homo sapiens
CAHQRPKSRGGRGRRRLVCYHHPAHTHTQLGRHSTWAWPQLWKLEQALGARRGQAVGAGTSKPAGAEGLPGPRESTGMPRSAAVAGQLQLPPEGQVSHSANLERGQGSHLFPAPAGSVECTAPAARP

SEQ ID NO: 790737 - protein, 151 aa, Homo sapiens
PSLCTSRCCHVAKEVFSSPSAMIINFLRPPQPCGTKRKRHQRCAHSETRHMRTQRQGGYLQARERGLGEANPAYALILDFQPPELQNLSEMGINHELGYSSIIPMMKRFWCLWEFLEPIPCGYRGAPVHVTCCVFIHRWVDTAAVSIPCLL

SEQ ID NO: 790738 - protein, 151 aa, Homo sapiens; identical to SEQ ID NO: 790737

SEQ ID NO: 790739 - protein, 180 aa, Homo sapiens
LYTGAFILNKNFTNVKNAAKPLLNPHPLINKRIHTGEKPYTCEECGKAFYRSSHLTEHKNIHTGEKSYKCEECGNAFYRSSHLTKHKRIHSGQKPYKCEECGKAFRQSSALNEHKKIHTAEKPYKCKECGKAFRWSRSLNEHTNIHIGEKPYTCEECGKDFTWSSTLTVHQRIQTGEKHS

SEQ ID NO: 790740 - protein, 101 aa, Homo sapiens
VMYQFGDFQVCAFSTFLFCFVLRRSLSLSPRLECSGAISAHCKLCLLGSRHSPASASRVAGTTGAHHHIRLIAFSTFLGEVCGNSKAFYMLNRMNKTNAEQ

SEQ ID NO: 790741 - protein, 455 aa, Homo sapiens
MASKCLKAGFSSGSLKSPGGASGGSTRVSAMYSSSSCKLPSLSPVARSFSACSVGLGRSSYRATSCLPALCLPAGGFATSYSGGGGWFGEGILTGNEKETMQSLNDRLAGYLEKVRQLEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 790742 - protein, 117 aa, Homo sapiens
MPSQRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPI

SEQ ID NO: 790743 - protein, 455 aa, Homo sapiens; identical to SEQ ID NO: 790741

SEQ ID NO: 790744 - protein, 104 aa, Homo sapiens [sequence omitted]

SEQ ID NO: 790745 - protein, 157 aa, Homo sapiens
CVPLVVGFLWPLRARLPSAMASVLNVKESKAPERTVVVAGLPVDLFSDQLLAVLVKSHFQDIKNEGGDVEDVIYPTRTKGVAYVIFKEKKVAENVIRQKKHWLARKTRHAELTVSLRVSHFGDKIFSSVNAILDLSVFGKEVTLETLVKDLKKKSRV

SEQ ID NO: 790746 - protein, 127 aa, Homo sapiens
CVPLVVGFLWPLRARLPSAMASVLNVKESKAPERTVVVAGLPVDLFSDQLLAVLVKSHFQDIKNEGGDVEDVIYPTRTKGVAYVIFKEKKVAENVIRQKKHWLARKTRHAELTVSLRVSHFGDKVFG

SEQ ID NO: 790747 - protein, 145 aa, Homo sapiens
IIRLPFCGPNQLDNFFCDVRQVIKLACTDMFVVELLMVFNSGLMTLMCFLGLLASYAVILCRIRASSSEAKNKAMSTCTTHIIVIFFMFGPGIFIYTCPFRAFPADKVVSLFHTVILPLLNPVIYTLHNQEVKASMKKVFNKHIA

SEQ ID NO: 790748 - protein, 108 aa, Homo sapiens [sequence omitted]

SEQ ID NO: 790749 - protein, 288 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHLQGEVVSCLEKGLVEAEEREPKIQVSE

SEQ ID NO: 790750 - protein, 93 aa, Homo sapiens
ALRNQLEQHSKTSSLQKIQKLGLTRSRSSLASLENVLHQKERINQEEEDRGSGNRDDGARKSQDDSCASGLQQPGWEQKDGELWECLQERKRN

SEQ ID NO: 790751 - protein, 131 aa, Homo sapiens
QGGGTPRQPGWLRRVEAGGAQPGAREGWHLAPTACPPARPPAQVGLGFPAFNNHPHRRGTEARNTPALAFQASRGWIIRAFRRRGREEKERWRPGDHTGRQCTELPQPSAATSYAAPETDRHCFSKAQPVR

SEQ ID NO: 790752 - protein, 125 aa, Homo sapiens
MWLPALVLATLAASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPA

SEQ ID NO: 790753 - protein, 113 aa, Homo sapiens [sequence omitted]

SEQ ID NO: 790754 - protein, 74 aa, Homo sapiens
MSICGHEEWPRMTMPGLSELFTRTGHGIKKVKTGRAQWRMPVIPALWEAKAGGSRGQEIETILANTVNTAKPCL

SEQ ID NO: 790755 - protein, 94 aa, Homo sapiens
HWGLLLPHWLLQDGPSASLVSPLGVRGRVYVEACFPGDGALICMLIFDLGPNRQTLSIAEESLGWHLVAWALGSAGPWSPAGLVPGRFGPISSM

SEQ ID NO: 790756 - protein, 63 aa, Homo sapiens
MICSLKNNGLKHAVKNVALQLDRPNTTFLLMASIYLHDQNPDAGLRALHQGDLECTAMTVQIL

SEQ ID NO: 790757 - protein, 101 aa, Homo sapiens
QHQAVAGWVLLCAVISVGVGKLAVSRPRCEAETGRREVSGPGWVDGDLLACTVSSLVKWGLHSPHLDRHVGTEVIDSQRGGASRSVPGGPWPGGGRHFPFS

SEQ ID NO: 790758 - protein, 137 aa, Homo sapiens
MPKAQRLLRVAPRIGLQRSERGGDGGCKGWLLQEREACPWLPAPVTPGDLTPRPSFPSSRPISGTLRLKEPRDLFKAARATTWSHKKALVRASSPWSLALHSSSRLSDLFPSAPLPLPQAWVPKALGHALGPGKRRG

SEQ ID NO: 790759 - protein, 206 aa, Homo sapiens
ARGTACVRVPPCLSPFLAPALSLRCPSSGSGEAQAKAGREGALWIRPRACPKIGPAGFPTHKRLLESGPRGPQAARPSLNSAATTAPALCPQQPWCHHPAESCQTTTRHDKGFFNCDGFLALMGVYHEKAQNQESELRAAFRVFDKEGKGYIDWNTLKYVLMNAGEPLNEVEAEQMMKEADKDGDRTIDYEEFVAMMTGESFKLIQ

SEQ ID NO: 790760 - protein, 74 aa, Homo sapiens
TSYPGLSHNGEHLLGTHLEPLNRHVSILVLDPNNLVFTPHCTDEEQGMDVEKLKLLNAGESLALKKWRTLVQKG

SEQ ID NO: 790761 - protein, 53 aa, Homo sapiens
MDRKAAGLSVLWGSGSAVTFPRRGQDFYANSSLCEGKAGCGSNSELAAGISTS

SEQ ID NO: 790762 - protein, 83 aa, Homo sapiens
WGWPEEGALGGLQLLESKPHKPTEDEVEGPTVNPTWPASESRAPQGGSAPCKPETWPSHCSELNLSFIVCELGMPERIEPGRL

SEQ ID NO: 790763 - protein, 144 aa, Homo sapiens
LRPDLSTGSTGTSPAARSRKGPSRMRKPQAESGGSSVASQPQACQDGVRGWSQPKSKKIVVSFHSSSLRTKPHNDRILKKKLGMGDGNNPCHWNTGLSGQVTSLAPLPLCLYRWHGAISCLGSGLCSVLPLALSPLFLRGLDVS

SEQ ID NO: 790764 - protein, 170 aa, Homo sapiens
MAYYFHFYGELPSQESPHPGVYSPHPQGGWQPTADSYREWHNEDLNPRMSHWTYAQELVSYKKTSFIVWRHRISPNGVTSRKPYCHFHGGQWPGPTPPSCLSSAFASGSFSHFEDSPYILLHVVLQMCWLRAQRLNQRDLGLNPTSAIEHQLSDLDCVPLLLWASDSPSE

SEQ ID NO: 790765 - protein, 143 aa, Homo sapiens
MIKQSSRVWLCLVTRRVYKGGQELRATAKIQNLQKPAADIEEPIYTMDKQSSAGGVKRSVPCDSNEANEMMPETSSGYSDPQPAPKKLKTSESSTILVVRYRRNFKRTSPEELVNDHARKNRINPLQMEEEEFMEIMVEIPAK

SEQ ID NO: 790766 - protein, 143 aa, Homo sapiens; identical to SEQ ID NO: 790765

SEQ ID NO: 790767 - protein, 102 aa, Homo sapiens
PRGLCMGTSRPSSLHVLQARSLKPPVMGMTESGMIFFCFLSKKTTKSSAYTDSHKPFARGSSVDLRRCHFSEEPSLLWNYSQPCNPPSPWTLLLLSVKTMLR

SEQ ID NO: 790768 - protein, 108 aa, Homo sapiens
VNLFCSTVKGQSWLLSPNGSEVRLHRFHSASTSCCATLIKCLSSPGPQQIRVTKIPTKMLVFMFKEHLPGQGQPPWKTPQQSWMGWRREVTTCFLLKETLNRKSLSHK

SEQ ID NO: 790769 - protein, 104 aa, Homo sapiens
VPIRSVPEVLSAKGNKVKVPDSMTTLVYPAHASPQLHPAWACLEDRWERWREMPALDPGTQTSCCSRDCLKVPQTWDWEDPVEDTESPTSNKEASSFLRNPQQR

SEQ ID NO: 790770 - protein, 118 aa, Homo sapiens
PRDSGDCRALRKRRKIKTQRSPGGARTREGLACRRGRGRFALGVARVSRVLSGTRPPVRMLPILGEPGRCAGVTSAHVVQVTPGEEQTPVCKTFRGFRASGSGRASRAAAQNYNPQAP

SEQ ID NO: 790771 - protein, 120 aa, Homo sapiens
HRIRALMPRPRHAYLLAGISLRPVWHRQRQGPALGAQGWQSRVIEAGGVQTVASPQELLALRELRAPQWGILAELQGKAGWRPGSSAPISSAPTLEGGQISMLTFVLTQLIQTIHKNKLA

SEQ ID NO: 790772 - protein, 106 aa, Homo sapiens
IQKSEVSDVERFAQDGRGGSGGGPTSADFHVQVQSCGFRFQNADPSENLSGHSLSFALFKNLILFLFKRENRALLAGRCKSSLWGLFVPGYVLSHTPTYLPSPPLA

SEQ ID NO: 790773 - protein, 68 aa, Homo sapiens
IGLFKDGQGSAHRWMDGSAPTYINWDSRKLDDNGTTPACVMMLYQGHWSNSSCKSESPVYICEKRQSC

SEQ ID NO: 790774 - protein, 110 aa, Homo sapiens
PRTVAFLIFLFAAWTVDPLDLQALPCLSLHAGGSGRLHPWGALGAAGDVHSEQWRAVVSSDLHAGELVRVAVGPLVKLPWLLTSKEMRKERYYRFSLRNKYCLLFLSFLW

SEQ ID NO: 790775 - protein, 1530 aa, Homo sapiens
IKSMSEDESEMITTVSEIESKAPTVESGTIASKERTLSSGQEQVVESDTLTIESGPLASEDKPLSCGTNSGKEQEINETLPITTVAQSSVLLHPQEEAARIRMSARQKQIMEIEEQKQKQLELLEQIEQQKLRLETDCFRAQLEEEKRKKTQPTGVGCRKSHHYINHLVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQVETTETLRASDILTNQALESQEHLRQFSQTETQQRDYKLVPKDSETLSRALSHDRQLISQDARKISETFGATTFQSLESQQLFSENSENISYHLTEPSSFVPLVPQHSFSSLPVKVESGKIQEPFSAMSKSTVSTSHSIISQMHDRPLLPSENITAQQGNMKALQEQLDLQKKVLQATQEAQEQLLLCKQKEVEQQTGLSVFLPLVTPDSSALLPSAKADLGRIQESSPTKNNIAVSSDHHVISQLQDKRLSLSQPILSQQNNFKFLQEQLNIQKDSLQARREAQEVLYVHKQSELDRRVCSEQAEPSFPFQVAQHTFTSLPSADTKSGKIQEQHSSKSEKGLVSCQSDIPISQDGSLSFLQQFLPLHDSLKLLQEQLTKQRDTLQARHEAQVELLLHRQRDLGDSKSGLVSSSSSPVVVQHSVASQASAKAEPRRIQELYLSEKENVGPSCHLIIPTFQDKSLSFPQHSLAQQENLTILQEQSQIQRVILGAKEGTQEFVHTESELEKRISSEQTGTSSSLSQVDESERFQECISIKSDSTIPLSHPKIPRCQERLLRVSQHMLPLQDNLEEHQAWLDTEKEAFHFSQKTQENTSSEQTGSSSFIPQLVQLSFTSLASAESGTILEPLFTESESKIFSSHLQIPQLQDRLLRISQLIQPQQDNLKALQEQLATQREAIILARQEAREELLLHQSEWEGRISPEQVDTSSLPLVPQHSFASLPLNESERNQEPCSINSDNIVSSGHSEIPTLPDGLLGLSHLVLPQQDNLIALEEHLHAQTDFLPSIEKTQKELVLSKPCKFEEKVSSEHFIQSHHGDLQALQQQLDTQKKAIRSIQEVQEELLLQRLSELEKRVSSEQVCSSSFVSQVPVADSERTQKSFPTKSNDTLPSSHREIPRLQDRLLSLSKPILPQQDNMTAQLDAQREVMYSYEKPQEELSLNKQRKLNKSESAEHTIPSLFLPKETEHSFIPLPFAEAKPKSTCELYSSQNEHAAPPSNPVIPGFQDRLLSFSQSVLTQQDNLGLQKQLDLQREVLHYSQKAQEKLLVQRQTALQQQIQKHEETLKDFFKDSQISKPTVENDLKTQKMGQLRDWFPNTQDLAGNDQENIRHADRNNSDDNHLASEDTSAKQSGEHLEKDLGRRSSKPPVAKVKCGLDLNQHELSAIQEVESPAIGRTSILGKPGIYEDRDPLRVSISREQSFFGSPLAHDPFSCLQLVGQENVCGDDYDEAGEK

SEQ ID NO: 790776 - protein, 1492 aa, Homo sapiens
IKSMSEDESEMITTVSEIESKAPTVESGTIASKERTLSSGQEQVVESDTLTIESGPLASEDKPLSCGTNSGKEQEINETLPITTVAQSSVLLHPQEEAARIRMSARQKQIMEIEEQKQKQLELLEQIEQQKLRLETDCFRAQLEEEKRKKTQPTGVGCRKSHHYINHLVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQVETTETLRASDILTNQALESQEHLRQFSQTETQQRDYKLVPKDSETLSRALSHDRQLISQDARKISETFGATTFQSLESQQLFSENSENISYHLTEPSSFVPLVPQHSFSSLPVKVESGKIQEPFSAMSKSTVSTSHSIISQMHDRPLLPSENITAQQGNMKALQEQLDLQKKVLQATQEAQEQLLLCKQKEVEQQTGLSVFLPLVTPDSSALLPSAKADLGRIQESSPTKNNIAVSSDHHVISQLQDKRLSLSQPILSQQNNFKFLQEQLNIQKDSLQARREAQEVLYVHKQSELDRRVCSEQAEPSFPFQVAQHTFTSLPSADTKSGKIQEQHSSKSEKGLVSCQSDIPISQDGSLSFLQQFLPLHDSLKLLQEQLTKQRDTLQARHEAQVELLLHRQRDLGDSKSGLVSSSSSPVVVQHSVASQASAKAEPRRIQELYLSEKENVGPSCHLIIPTFQDKSLSFPQHSLAQQENLTILQEQSQIQRVILGAKEGTQEFVHTESELEKRISSEQTGTSSSLSQVDESERFQECISIKSDSTIPLSHPKIPRCQERLLRVSQHMLPLQDNLEEHQAWLDTEKEAFHFSQKTQENTSSEQTGSSSFIPQLVQLSFTSLASAESGTILEPLFTESESKIFSSHLQIPQLQDRLLRISQLIQPQQDNLKALQEQLATQREAIILARQEAREELLLHQSEWEGRISPEQVDTSSLPLVPQHSFASLPLNESERNQEPCSINSDNIVSSGHSEIPTLPDGLLGLSHLVLPQQDNLIALEEHLHAQTDFLPSIEKTQKELVLSKPCKFEEKVSSEHFIQSHHGDLQALQQQLDTQKKAIRSIQEVQEELLLQRLSELEKRVSSEQVCSSSFVSQVPVADSERTQKSFPTKSNDTLPSSHREIPRLQDRLLSLSKPILPQQDNMTAQLDAQREVMYSYEKPQEELSLNKQRKLNKSESAEHTIPSLFLPKETEHSFIPLPFAEAKPKSTCELYSSQNEHAAPPSNPVIPGFQDRLLSFSQSVLTQQDNLGLQKQLDLQREVLHYSQKAQEKLLVQRQTALQQQIQKHEETLKDFFKDSQISKPTVENDLKTQKMGQLRDWFPNTQDLAGNDQENIRHADRNNSDDNHLASEDTSAKQSGKPGIYEDRDPLRVSISREQSFFGSPLAHDPFSCLQLVGQENVCGDDYDEAVKLKESVLKIMQC

SEQ ID NO: 790777 - protein, 68 aa, Homo sapiens
SPGACIGKKGQTGPPYWLTLRRGWGKRAEGAQGQAGAAEDPWELRVHKGAALPGLQAASPMGAEKVQS

SEQ ID NO: 790778 - protein, 263 aa, Homo sapiens
SGSPDTSPVPLVPQRTGLLQLCPHSPKSLVFPPAGSLWPHQEKKMAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRAL

SEQ ID NO: 790779 - protein, 263 aa, Homo sapiens
SGSPDTSPVPLVPQRTGLLQLCPHSPKSLVFPPAGSLWPHQEKKMAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVVSLRTAGVQERRKQGLRCVACGHRRGSPGC

SEQ ID NO: 790780 - protein, 126 aa, Homo sapiens
MKPSQKALSLQAEDLLGQRPTLTPALNSIAAKWIFLVPRPLVVFPNIFYFQPTPRFSVASLESVRSPASAEHVPLLLPQCLPNSPETATPHQAKARTPSGFLMLCPRTLCHSECQPHQFLQVNKHS

SEQ ID NO: 790781 - protein, 77 aa, Homo sapiens
QWSSHKVAFDKINSYLMEARYSLSRFRLLTGSLEAVQVQVDNLQNLQDDLEKQERSLQKFGSITNQLLKECHPPVTE

SEQ ID NO: 790782 - protein, 75 aa, Homo sapiens
ALGPPLFVCRVGVYIKALRGLSFGLSLVQVACTPPACSPAPLNPWEPQVAIFICQVQSSEPGNPSTLGGRSRWIT

SEQ ID NO: 790783 - protein, 95 aa, Homo sapiens
RLAQSSTRGDGQASQGQRESDAGLERCGGECGPRGAKSSRSNWVSGWARQGLVGWARKTERGAHLTPGRTEGVGQELDLGRLGPPRGLQSSPSPP

SEQ ID NO: 790784 - protein, 113 aa, Homo sapiens
LSLVLFCELLESKAHHVYFFVFCLFVCFGSPWHMVVQWVCSKFWSRDLPSYLPLPSPRSYLLSVVSPSCFPFRHSGHPLLISHTAPAAHRDLHILFLSLEFSPFYIWPTPTHL

SEQ ID NO: 790785 - protein, 121 aa, Homo sapiens
VNSLSQSLSANPLTASTLVHLDLSGNVLRGDDLSHMYNFLAQPNAIVHLDLSNTECSLDMVCGALLRGCLQYLAVLNLSRTVFSHRKGKEVPPSFKQFFSSSLALMHINLSGTKLSPEPLK

SEQ ID NO: 790786 - protein, 81 aa, Homo sapiens
EAGSPEVGVLAGRALLKPPGQGQPHARLLAWAPASGPRRSPAHCCMAPTSASPTMWPPPGVSVSKSPALSKDNSHWSWDPS

SEQ ID NO: 790787 - protein, 100 aa, Homo sapiens
QAAQVSAWLLVRLQGGSKRREEAPGSLMQESLTSRRVHGLLEVGHTAGGGWQASERYRLSSASCQISGGIRFSLDHEPHRELHARDLGCTLLMRIKCLMI

SEQ ID NO: 790788 - protein, 88 aa, Homo sapiens
RWFWARVGPALCGRSGEPNSSVERGEERREWGRKGHIIPVNGGDPQTSAWLGLGIQHPHGKLSREVDSLWAPSLGKALRLIPPAHLCT

SEQ ID NO: 790789 - protein, 88 aa, Homo sapiens; identical to SEQ ID NO: 790788

SEQ ID NO: 790790 - protein, 102 aa, Homo sapiens [sequence omitted]

SEQ ID NO: 790791 - protein, 102 aa, Homo sapiens [sequence omitted]

SEQ ID NO: 790792 - protein, 654 aa, Homo sapiens
YSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADR

SEQ ID NO: 790793 - protein, 289 aa, Homo sapiens
TTGSRRVECCSQPRASQTRVGVPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLVWGRIPCLCDRLGPSDSHGGWADAAECRGSTQPRIARLSLDAPRGWLGKPPTA

SEQ ID NO: 790794 - protein, 325 aa, Homo sapiens
GPPARGAWRLLPAARESDSGGGPGGGSGGGGASMSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLVWGRIPCLCDRLGPSDSHGKHIHKTGLAGGCKAAFSEAEVGGSRGPEIEIILVRVKPCFY

SEQ ID NO: 790795 - protein, 75 aa, Homo sapiens
AEPILCALRYRHRGFNESSAECRVCHGYHFHKGQQSLIPQDHYDPFKESWTPSEPGQNSRVDHYQLLNSRPASTN

SEQ ID NO: 790796 - protein, 106 aa, Homo sapiens
GSLGHNAVSARQALLRWVCTLLSEQDWSHPAAATSHLQLGNAHLNRLQSHPVKDQALGCHGGWWLHLDSAGMGHFPFITESSSRRCCTRVSTALSLQEAMCRLHLS

SEQ ID NO: 790797 - protein, 107 aa, Homo sapiens
LAQSSRGQKDLSWTLRTSSQHRSVRVAGWSREPELHTVLLQKGLGSLGGVHPQKHPRAGTSGQLPRPSLGRHASLQLQPRMHGGFPKVLEVPLPSIEPGFPFPAPLV

SEQ ID NO: 790798 - protein, 72 aa, Homo sapiens
VDAAVFVTRTDFCVHKDEPCDTVGIAYLGGVCSAKRKCVLAEDNGLNLAFTIAHELGHNTPQETDTEDLEWL

SEQ ID NO: 790799 - protein, 201 aa, Homo sapiens
RSASPTPQTRAADDPAAAMALLRGVFVVAAKRTPFGAYGGLLKDFTATDLLNCCKVMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDACYFK

SEQ ID NO: 790800 - protein, 120 aa, Homo sapiens
RAVFLSVTLSSCSKHMYLKQLYTKLIKIKDGQPVPGNVEEELVIEFPWWDKRITHLAFNERFPELHPFPSLTAGSCRPCGAHSGRGKMRPEARRCALGAMRTQPSQVNAASATARALIII

SEQ ID NO: 790801 - protein, 111 aa, Homo sapiens
MQPFAFAMPCPVYFLRGLFLYFCRINFSNLELEGTIYVCVCIYIYKRKTYIYFNYLKCKNLPNTNGKSDVYYIILLFVHLCDLFTHFMFFIYKIVKLAKIILVFLIGREET

SEQ ID NO: 790802 - protein, 68 aa, Homo sapiens
MGADFQFCKRNYEHSLYSLLFVIVYVISEVICLSYSNVFKARESEKREEERKVFKLISFEFKMHIKYN

SEQ ID NO: 790803 - protein, 342 aa, Homo sapiens
AGGLAGMGGIQNKKETVQSLNNHLASYLDRVRSLETENWRLESKIWEHLEKKGPQVRDWSHCFKTIEDLRAQIFTNTVDNARIVLQINNAHLAADDFRVKYETELAMRQSVENDTMGSARSLMTPMSHRLQLETEIEALKEELLFMKKNHEEEVKGLQAQIASSGLTVEVDAPKSQDLTKIMADIRAQYDELARKNREELDKYWSQQIEESTTVVTTQSVEVGAAEMMLTELRCTVQSLEIKLDSVRNLKPSLENSLREVEARYTLQIEQLSGILLHLELALTWAEGQPGPGLETLLNINVKLEAEIATYRRLLEDGEDFNLGDALDSSNSMQTIQKPPPAG

SEQ ID NO: 790804 - protein, 92 aa, Homo sapiens
MKVGSGASEDGLLFGGKVPGATAVTPLDTLVCPERRGKQGPSPTGPHTPEPHTAGPHTPEPTQRAPTHQNPTQRVPPHQNPHSGPPHTRTHT

SEQ ID NO: 790805 - protein, 70 aa, Homo sapiens
AQDVAGMANSIAIRGRQGNRGNGHKVQEVEGSRVTQRVHAPPKGIQIYYFKNSMLTSRVSWGLRLQPCRW

SEQ ID NO: 790806 - protein, 108 aa, Homo sapiens [sequence omitted]

SEQ ID NO: 790807 - protein, 108 aa, Homo sapiens [sequence omitted]

SEQ ID NO: 790808 - protein, 169 aa, Homo sapiens
DLFENRKKKNNIKLYVRRDFIMDNCEELIPEYLNFIRGVVDSEDLPLNISREMLQQSKILKVIRKNLVKKCLELFTELAEDKENYKKFYEQFSKNIKLGIHEDSHEMVSLKDYCTRMKENQKHIYYITGETKDQVANSAFVERLRKHGLEVIYMIEPIDEYCVQQLKEF

SEQ ID NO: 790809 - protein, 127 aa, Homo sapiens
KKPYECTQCGKALSSLTSFQTHIRMHSGERPYECKICGKGFCSANSFQRHEKTHSGEKPYKCKQCGKAFIHSSSLRYHERIHTGEKPMSVSNVGRPSDLPHTFNCMVGLTLERSPMNVRNVGKPSDL

SEQ ID NO: 790810 - protein, 130 aa, Homo sapiens
MDMHKAIPKVTIRMSTSSSKLGQKFNRSVGGYSSWELAEFYRVREWETPGVSLIYAMRDSLLAIGSSGWPLQSFCRVASLGLDAYCALRWLVGTGPVNSSLDVLVLVLCVGSVSKGPLAVQFRAKDWAGP

SEQ ID NO: 790811 - protein, 77 aa, Homo sapiens
ENQLAEIRCDLERQNQEYQVLLDVKARLEGEINTYWGLLDSEDSRLSCSPCSTTCTSSNTCEPCSAYVICTVENCCL

SEQ ID NO: 790812 - protein, 122 aa, Homo sapiens [sequence omitted]

SEQ ID NO: 790813 - protein, 80 aa, Homo sapiens
NGRERQSVDQVQVKGSPIMLGIRSGRFTHYLRKLVFVTDKSCSASWETQAPVLVPSSCTQMLSFNSSVTVLDPSSLPIRG

SEQ ID NO: 790814 - protein, 137 aa, Homo sapiens
LTSWCLPNPPNHHRTIPSHTLLTRRFNRLLIDRPYHPRRKLWLNHPLPSRQWRLNILHLPLPTHRPRPILRLISLPRNLKHWHHPPTYNYSNSLHGLCPPMRPNILLRGHSNYKPAIRRPIHRNRSGPMNLRRLLSR

SEQ ID NO: 790815 - protein, 337 aa, Homo sapiens [sequence omitted]

SEQ ID NO: 790816 - protein, 572 aa, Homo sapiens
MDDDYEAYHSLFLSLLGLCPSKTPINENAPVFDPEPVIAHCFKQFQQKDFRLPQTRRRIIMVPRKEDQTPLNPASQPQAPPKPIPSFKVLEARDIQEQPEDRKTWLSQRSKLRQELESFGDVKRWLENKPSITPSEAKVLHMIHEEQSAQPNASQATTRTTRKKAPRLSRLSRQMVPQLQLPEPPALSVMYSYLHSRKIKILEIFHKVGQGENQRITREEFIAAVKAVGVPLKNQEVEDIVIYLSSLGKHNTITMDILANTYKQWSMAQQRSSLATAREHYILAKHRDSLKGPLKKQEVDSAPQLPKVDLLTVPAVDTQMETRPMTLEEMEEVGKRYRERQRQHKLTIPSIQYTEQCHLVRCGNRHFDEHCLPSTIHGDMRELIDSARRHNFLVYLQCWKLCKSYGLPLTEDILMKALLYPGDKIIFQMDKVCPIRQPGGYYSDWKVFSPNLALLRSQGPGKSKRTDKKTPKKSKKMRFKEFEEFTRKLKVKRSSGLQQTHPNSFWPGHLLDKLQLYLPTVATDRSLALFSCVQHQPHVYPATYHPDHWWPLRNKNYMTHAHYDAAKVYYIN

SEQ ID NO: 790817 - protein, 422 aa, Homo sapiens
MKRTTVCSCRCSKKAPRLSRLSRQMVPQLQLPEPPALSVMYSYLHSRKIKILEIFHKVGQGENQRITREEFIAAVKAVGVPLKNQEVEDIVIYLSSLGKHNTITMDILANTYKQWSMAQQRSSLATAREHYILAKHRDSLKGPLKKQEVDSAPQLPKVDLLTVPAVDTQMETRPMTLEEMEEVGKRYRERQRQHKLTIPSIQYTEQCHLVRCGNRHFDEHCLPSTIHGDMRELIDSARRHNFLVYLQCWKLCKSYGLPLTEDILMKALLYPGDKIIFQMDKVCPIRQPGGYYSDWKVFSPNLALLRSQGPGKSKRTDKKTPKKSKKMRFKEFEEFTRKLKVKRSSGLQQTHPNSFWPGHLLDKLQLYLPTVATDRSLALFSCVQHQPHVYPATYHPDHWWPLRNKNYMTHAHYDAAKVYYIN

SEQ ID NO: 790818 - protein, 72 aa, Homo sapiens
SYTSVHSFNLHSSPGGHPGMECTALPDRKRFGCLRNNSLSGLLMRREAMVSFFSALNGSLDVTTARNHWRDK

SEQ ID NO: 790819 - protein, 81 aa, Homo sapiens
ELLPGSWIQLLLTAGGPKPEGLSTCPVPKRCTEAGRGSAGADQPAHERRVQLGFLGRVGVQKAVKHSFPASGLTSVLDEEY

SEQ ID NO: 790820 - protein, 69 aa, Homo sapiens
FFSEKPRLGLDHRPNISGFQSQSGKSLSCKKTKEGAGPTHAGYSERRENNCSFYQKRRSRILLLDSFLG

SEQ ID NO: 790821 - protein, 131 aa, Homo sapiens [sequence omitted]

SEQ ID NO: 790822 - protein, 166 aa, Homo sapiens
RRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKE

SEQ ID NO: 790823 - protein, 76 aa, Homo sapiens
AALDGSREATNSTPTKSQNFKPERDLKPDPTHLSDTETEAWEERLSCSRSQRLLLGAELASKPGLLTASQGHAPQQ

SEQ ID NO: 790824 - protein, 115 aa, Homo sapiens
EGERKAKGLNVTFIETRAKAGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 790825 - protein, 92 aa, Homo sapiens
ACLAVGMGNAVTTPGWHPIPHPGEWGSQEVDWKQAQASLSLPPRASSPAGGHYNADVKLVSGFSGRFGYRGNTPALRQSTSVFGEVTHFPLF

SEQ ID NO: 790826 - protein, 54 aa, Homo sapiens
MQISLQQAPGNLLITKSRNAVIPDRQCKGVVERGLSARVGIPALSVSLNSVLGY

SEQ ID NO: 790827 - protein, 86 aa, Homo sapiens
CGHFRSLLEAPEPDVEAELSRLSEDRLARPEPLNTTSGSPSRRRRREAAEDPAGRVAGPGEVSDGCREALAAWLAPQAASLSWDRL

SEQ ID NO: 790828 - protein, 58 aa, Homo sapiens
KHVHTMEQNGNCAHVLQVKHKTPQEFQACSEPLGTPLVSADPWWHTLKSNAMRSHSRY

SEQ ID NO: 790829 - protein, 137 aa, Homo sapiens
RAQTLSGTQALPDPGKSPLRLPVGHGHIEGMLESPWVKQVTLWGGHPLPAHCCPYPPSTGCQGRCPVEGGRWFIPISLLREDTQTCAVITVEHFHHPRKTPCTHRPSLPCPFLPATSNHRLVGAFCFHGFANSGYFV

SEQ ID NO: 790830 - protein, 137 aa, Homo sapiens; identical to SEQ ID NO: 790829

SEQ ID NO: 790831 - protein, 119 aa, Homo sapiens
RRGQPPFLTDMPNLHQTKALWAEAIMVIAAICEGLSSGGCSRDNDKALDCHTPSFPSHAGFELGQEASPEEEGRTHQDSSLLNTQASALVPTLTSTGHSVLSACLCPTEPPAPQHKTLV

SEQ ID NO: 790832 - protein, 110 aa, Homo sapiens
EGKIMSLRASLCHFSLDGGHRGPLLAEGCHCCLPHLYPQGPCSHWVRPLGHGVPSALFLDKPILCRSLPSTPVFRNSARFLQPHPYPPPNLLFFWCPSLSMANRSTTQRS

SEQ ID NO: 790833 - protein, 74 aa, Homo sapiens
MSTCSHQFTSSRSMKGSCSIGGSIRGGSSRISSVLAGGSCHAPSTYGGACVSPSLASPLGEPAGWGAAMAVASA

SEQ ID NO: 790834 - protein, 83 aa, Homo sapiens
SPAAKPQPAILRPALQPPPQSLLTWRRRPPPAQPRTGAASPESFPSVDTFALQQPRETVFRSCALEWLFLHLSASSPPNSGRE

SEQ ID NO: 790835 - protein, 94 aa, Homo sapiens
NIEGPEGKLKGPKFKMPEMNIKAPKISMPDIDLNLKGPKVKGDMDVSLPKVEGDMQVPDLDIKGPKVDINAPDVDVRGPDWHLKMPKMKMPKIS

SEQ ID NO: 790836 - protein, 104 aa, Homo sapiens
MARLLRRPSRCFSALLGSSRLASAPPIGLGFSGSSRPTSAPTTRLWLPSPSLGFSAAPRLSSFSSAFSARLQFSPISPLQFGSFRVSPWHPGLGVALGLVGSLS

SEQ ID NO: 790837 - protein, 102 aa, Homo sapiens
PQASIHLPSLTLSEAITLLSQDRRGEKNENSAQGTMEGKWDSFRTGSTDTSGQGEMTTSSEKWRAPPDGKASCPGTSAQSFSESAPHRAPHLHAVLRTDCLA

SEQ ID NO: 790838 - protein, 72 aa, Homo sapiens
PQASIHLPSLTLSEAITLLSQDRRGEKNENSAQGTMEGKWDSFRTGSTDTSGQGEMTTSSEKWRAPPDGKAR

SEQ ID NO: 790839 - protein, 89 aa, Homo sapiens
HGNYPHIPGCNHSHCCALCWIGLHCERVFPASIKSIHQGYLSSPCHGLQYTIKRTPAVTTVGSRKRRPLIRLCKTIQHDVYPQASTPPP

SEQ ID NO: 790840 - protein, 117 aa, Homo sapiens
MGGDKVSPKRRRERGKGRKKRQSLKVDRNSSQKLQSQGNPTQRAGDVGVCLCLAPFIPSGWPPLPSEPFGSSCPPEGLPSPTTTVLTVCPRILDPPTFLGLLLVQVISTGAISGSPG

SEQ ID NO: 790841 - protein, 121 aa, Homo sapiens
SSSALSFPILCGGPACPRPAHRGCQGPRPGSGLEVTRPQMICTPFFSGLVLCGKVSTVRGYRHVSQAVFDFLLSLSLSLYLSRLQINEDLISQEIWVSFFFLRLCQQWPGACESGPFSLSN

SEQ ID NO: 790842 - protein, 76 aa, Homo sapiens
LPSPSSLLFCSPGKFWTSLAQGLRGLASPAPVGTGQRDKADHLSLLEGRYPRAVVIRECHSGHIPAWAGLYGEVPV

SEQ ID NO: 790843 - protein, 109 aa, Homo sapiens
VTLFHHYHLPYTPGGQQSKIRSPTLTSRCLQGWFHLETLGENPFPCCFQLLVATCIPWLVAPSSIFKVHHPISAPSPHHRLPFCSQMFLCLLFISILIIIFMAHEDNPG

SEQ ID NO: 790844 - protein, 39 aa, Homo sapiens
MNQPLNGLQFPACNGAIPLFHLIYWRAEWHAGIGSHPAG

SEQ ID NO: 790845 - protein, 43 aa, Homo sapiens
MLTALGQVNNIQKEFTIKKTKQADHNLVARIDEIQYVQGTINL

SEQ ID NO: 790846 - protein, 140 aa, Homo sapiens
MHQCILKRHMRSHTGERPYPCEICGKKFTRREHMKRHTLVHSKDKKYVCKVCSRVFMSAASVGIRHGSRRHGVCTDCAGRGMAGPLDHGGGGGEGSPEALFPGDGPYLEDPEDPRGEAEELGEDDEGLAPEDALLADDKD

SEQ ID NO: 790847 - protein, 109 aa, Homo sapiens
MALHWGTALGSHLPLTARHVRVAEEETHPVDLSSLSSKLLPGFTTLGFKDERRNKVTFLSSATTALSMQNNSAFGDLKSDELELLYSAYGDETGVQCAPRWTPAPGASV

SEQ ID NO: 790848 - protein, 81 aa, Homo sapiens
MPLVIYDNGLLHDTKSPTIKRQSRYIGFYQNLKLGTGLSIQIRKSKIQNAPIENLNLSTNMTHNKNAHLNILEFRFGRLNW

SEQ ID NO: 790849 - protein, 52 aa, Homo sapiens
CAPQGKGSHGNPANSCLKNSSLFNAVDVSGTLKSFLQGVGWEEEEDAELVFL

SEQ ID NO: 790850 - protein, 105 aa, Homo sapiens
VETRFHHVGQAGLELLTSGDPPASASQSAGITGMSHCTQSSFRFIKLSWFELSICFVCDMVSLEYTGTSLELLGLNDPPTPASQSTGITGVSHCAWLPLLLRFFR

SEQ ID NO: 790851 - protein, 115 aa, Homo sapiens
MYISHVLSDVSCPEHVSNQLHPNPLGPHMFSGSPGTASWAFRHSYLAQNHSPSILQGFTLFLDNPQRAATVGGSETAGLQGMVLPKLHVQTQLEAVLPRGWSEGPQERPTQEFPT

SEQ ID NO: 790852 - protein, 113 aa, Homo sapiens
QQGFTPRSVSLVDSCAVQKRLGLLCVCTGGCGEWGGHLWVVLVQATCTEGAGALRGGSEALSLHFSLWNVTLTPFPSALVKTTNMPQYTQSVLLTLLPVWKIRVCFPKCHQGT

SEQ ID NO: 790853 - protein, 131 aa, Homo sapiens
FREPGTQIKVLSFCLEGKPSSLKSNLTSPALAGIVDAQIELASPRLICPEYPSPLLCSMTQSTPFPRVGLGQPLQILLCYSHCNKTMWWAQNEGRHCFSAFQQLSIAVSGASERKICGTLRIHSSPGQNLQ

SEQ ID NO: 790854 - protein, 108 aa, Homo sapiens
QSAVSSALNLSSAWEVPPLPACDWSARAPRSRIGCQYQPITCCLAPGLSGRCSPAPQFPAGAFRVSVCPGSGSVSLSGPSKEKSQRQVRADLDTLCGVEPEILVPFCC

SEQ ID NO: 790855 - protein, 242 aa, Homo sapiens
MCTPVDVCDTQCTYLCLEGLPMSLCVINPGPHASWGAHKHGFLMASSPAPQVLFFPSPHVTLLPWLPAQPAHGLSLPTPPACPHLLPLLEIPSGMFRLLPCHSPGLEHPHFLLSGPTSTPAWILTEMLPPLDRPQSLRSPALPSSCSPLPHGASSYLLPCVGADAPKLGALWLGLTPMASLTPVLAEPIVVHTILSSVAPESLGPSIPLLKVERLSQGWGQPSDTWSSHTWLSGTRPCPSMM

SEQ ID NO: 790856 - protein, 92 aa, Homo sapiens
HVKTLGQGVAHEVARNGLHFLPQKTTIALMKLKGEGGFSSKLRVECLVGQGQNCVEDPAGCSMEPSECMEPVAKQTRIFDMISVGAVRPWVA

SEQ ID NO: 790857 - protein, 149 aa, Homo sapiens
IRHEERLEICARVTHKHTRTHNPKTTTTRSQPLLAEIILKANGGISQQQEGRRRMKRRPGRSCKLEEKNARYCPSPRPWQAGDGVERSGVALRTPNFLGVPVKKGRNGSEQRNSLLQPALASPPSSFPQASRRPGVSHSGCRDFFSRLF

SEQ ID NO: 790858 - protein, 148 aa, Homo sapiens
MRDTIIFFFSFRNRVLLPPLRAVVQSQLIAASNSWAQVILPPLPPPPQELELQDPILVRDLMMFTVKTEAKKAHTARPRSLITRSIREEGPQLSDGGRPSFLHGRGGGQGLRAAAPGTSGGSEAPGSQSEFILREMESCGRLWEEGQD

SEQ ID NO: 790859 - protein, 106 aa, Homo sapiens
CIHLRFRTPWSRDLSFIHLRPSWSQPASSLLRGRHSHTSPLIMGGPSAKSLTQNVTRSLCTWLRSCKRGNHTGPGGLSHLSHITYHPHRGHCGSGGARRMTPHAGI

SEQ ID NO: 790860 - protein, 122 aa, Homo sapiens
MAHQALHDLPSPPPSTPATQASSLFFQHNMPGVVLPQGFGTTCPSPLAWNALTSCRCQGHVTSSKKPSLASCPGCPGFSERSPLHTTHAGTNHMFTSVTINTAGSAPGPDRLWFPGPGPLQA

SEQ ID NO: 790861 - protein, 122 aa, Homo sapiens; identical to SEQ ID NO: 790860

SEQ ID NO: 790862 - protein, 90 aa, Homo sapiens
LSVRVLDHKDRKQDSLEGTWAEERVLTEPTGDWGTRLRPTGAKGASEGKEAWCKRIANITQPEQPVQGRCCRGWLCTGSGSRPARHSPLS

SEQ ID NO: 790863 - protein, 109 aa, Homo sapiens
MLTSITVSVSLDFPIPGPRRVQLPYTATAFCPSVAWPCVAQCRGSLSVSEAEGRLVPHSLCASQAALMLCAPNLCRTGFRPGQRRLCPHPRCSQCPRTLSTGINLVSLQ

SEQ ID NO: 790864 - protein, 128 aa, Homo sapiens
QAPAHLPAAQGGQSRLHRGQRLLGRGQAGTPCMQCWVGTSCTGRDAGVWGPGHVSCPVREPGLVREALWAPRCFPALGSRGGTGVGKSGSPSSHRLHLYLHRGCPGQILGLLVLQLSFVISMRGVPTH

SEQ ID NO: 790865 - protein, 355 aa, Homo sapiens
MKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNRYSFNLEKRIPRLEKDEKFSEG

SEQ ID NO: 790866 - protein, 196 aa, Homo sapiens
MKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGKCSRVIESKPSESMNTRRVLGDSGEINILTGQAPLALAIF

SEQ ID NO: 790867 - protein, 124 aa, Homo sapiens [sequence omitted]

SEQ ID NO: 790868 - protein, 66 aa, Homo sapiens
RLRRRGTGSGLLVPAEPWAGPDPGPRLPHPAPPSRGLGASSESRVPHRTALDSGPLRPSQLAVHFK

SEQ ID NO: 790869 - protein, 66 aa, Homo sapiens
VSATGVDNAGPYKASCWLLRAFLLWAERIKKHHDCPFSGKDTRHTLTAQKRHFFLFLVSSFTINLN

SEQ ID NO: 790870 - protein, 61 aa, Homo sapiens
MVRSSTRMSPTWASKLAAAAGRARGGGDVPASTVPSSLPAVLGRGARLLSGPSAGARTGGG

SEQ ID NO: 790871 - protein, 113 aa, Homo sapiens
WFYPLIITITEVGVIPVEMQVIVLAEHTAPALNYTQVALHLLTNKVNQIRKVVQQNCMAAHIVTTAQGGTCALAGTQCCTFIPNNHHNITAALQGVSQEIKVIEHLTEDPLQR

SEQ ID NO: 790872 - protein, 135 aa, Homo sapiens
QDPSSLAFSFLICPQPQNPGRRLPQWLVHSCRPCEHIYFLVGRAREPLVESSPRVQEPHSPALGPPGREKTKVMLLNLDARREQLWGKACLEPRKTCLPGAIPHTSCRQGQESHRLHCSCNLACGRKAQNVPQRS

SEQ ID NO: 790873 - protein, 132 aa, Homo sapiens
YVKIVPASSLPSTMIGSFLRPSQQQKPIQSDSSPAIPQWLGDSHFKSVEFYPEGGCVDSDYILSSMPIWVRPCDEWSSVEYEQKCYVSEEDMPSPSFLFPYPLVCVGFQGVLGRGLGHNFKRHSAKYHNPKC

SEQ ID NO: 790874 - protein, 85 aa, Homo sapiens
YVKIVPASSLPSTMIGSFLRPSQQQKPIQSDSSPAIPQWLGDSHFKSVEFYPEGGCVDSDYILSSMHGLRPSLLTLPGCGCARGE

SEQ ID NO: 790875 - protein, 98 aa, Homo sapiens
VSPCVPVVPRGIGGPGSGRSRGPAALLPCAEDVAPRYPCGSWCPSEMRAHWRPTCLGDTGGAAPRFVRPVPAVPSAGPRGWAALCICIWIPTFVLLIH

SEQ ID NO: 790876 - protein, 67 aa, Homo sapiens
MWSRDDHTCGIIRENTMARHPRTAGSFPAFKTEMQPSADTQQPTPPGPNHRGQRHAGPSGPMVPFSA

SEQ ID NO: 790877 - protein, 70 aa, Homo sapiens
RSEDSNLSNFTPVSATNITLHHNRGHQYLSQFSSILQVQSLASSSTGKERAFGEEITSGISPSVVFSQRN

SEQ ID NO: 790878 - protein, 255 aa, Homo sapiens
SPPAVNGQANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALTGPHNQPSSRDPLERPQHQQ

SEQ ID NO: 790879 - protein, 196 aa, Homo sapiens
SPPAVNGQANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLGNGARPERRP

SEQ ID NO: 790880 - protein, 216 aa, Homo sapiens
QHQAVAGWVLLCAVISVGVGKLAVSRPRCEAETGRREVSGPGWVDGDLLACTVSSLVKWGLHSPHLDRHVGTEVIDSQRGGASRSVPGGPWPGGGRHFPFSLRGFIDLVLQVVWPEGRCGLQSSSLGQVQGSGVLSCHWRRASGPPQQLPPAQPQRGCVPGSPAPGDTISTEVASLNQGLPREGLRLGCGITPSLGSRQGWPGTVAHASDLSPLRG

SEQ ID NO: 790881 - protein, 110 aa, Homo sapiens [sequence omitted]

SEQ ID NO: 790882 - protein, 151 aa, Homo sapiens
QKYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPRWALVWLWPFLASPLPGDGITFQTTADVGHTAS

SEQ ID NO: 790883 - protein, 151 aa, Homo sapiens; identical to SEQ ID NO: 790882

SEQ ID NO: 790884 - protein, 126 aa, Homo sapiens
SLTSCLFHFLAAGRRCLLLCPERRKSGCLARGLSKGKPGQWSHPAHSVRGPPRTTWLRHPSRGGDWPLHPHGKHANRPPPITASCFLDGINCLAFGQDYFCTKQDCYHLIENNYPMQIEFNLSSWK

SEQ ID NO: 790885 - protein, 121 aa, Homo sapiens [sequence omitted]

SEQ ID NO: 790886 - protein, 121 aa, Homo sapiens [sequence omitted]

SEQ ID NO: 790887 - protein, 111 aa, Homo sapiens
MLVCEKSNFEQDKPEARFSGRRGATIARSQVREAQFDELLNQMRHRSHEEILKFHLRKAKDFLKNMKSRSADEMPKDRKGWPEIYNYGHRQPTQVPSSLVSKLRTKVLPLT

SEQ ID NO: 790888 - protein, 67 aa, Homo sapiens
LLIFATRWRSYHMLSACSFPACAQGGFGGVGYAVCPLQIPGCPTSRNLAMQGKAHILSPASLGSNAV

SEQ ID NO: 790889 - protein, 132 aa, Homo sapiens [sequence omitted]

SEQ ID NO: 790890 - protein, 285 aa, Homo sapiens
MWEVRFEAILVQPKVQVGGCGWGAWALGPAPCAAEAVARRIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 790891 - protein, 326 aa, Homo sapiens
MQGARALRDQGRSPGRMSALGRSSVILLTYVLAATELTCLFMQFSIVPYLSRKLGLDSIAFGYLQTTFGVLQLLGGPVFGRIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 790892 - protein, 83 aa, Homo sapiens
MSALGRSSVILLTYVLAATELTCLFMQFSIVPYLSRKLGLDSIAFGYLQTTFGVLQLLGGPVFGRFADQRGARAALTLSFLAA

SEQ ID NO: 790893 - protein, 873 aa, Homo sapiens
AGRAPGCLSNPSAFCSWTVAAAGSMMEPPKPEPELQRFYHRLLRPLSLFPTRTTSPEPQKRPPQEGRILQSFPLAKLTVASLCSQVAKLLAGSGIAAGVPPEARLRLIKVILDELKCSWREPPAELSLSHKNNQKLRKRLEAYVLLSSEQLFLRYLHLLVTMSTPRGVFTESATLTRLAASLARDCTLFLTSPNVYRGLLADFQALLRAEQASGDVDKLHPVCPAGTFKLCPIPWPHSTGFAQVQCSNLNLNYLIQLSRPPEFLNEPGRMDPVKELKSIPRLKRKKPFHWLPSIGKKREIDISSSQMVSLPSYPVAPTSRASPSPFCPELRRGQSMPSLREGWRLADELGLPPLPSRPLTPLVLATESKPELTGLIVAEDLKQLIKKMKLEGTRYPPLDSGLPPLLGVVTRHPAAGHRLEELEKMLRNLQEEEASGQWDPQPPKSFPLHPQPVTITLKLRNEVVVQAAAVRVSDRNFLDSFHIEGAGALYNHLAGELDPKAIEKMDIDNFVGSTTREVYKELMSHVSSDHLHFDQGPLVEPAADKDWSTFLSSAFLRQEKQPQIINPELVGLYSQRANTLQSNTKKMPSLPSLQATKSWEKWSNKASLMNSWKTTLSVDDYFKYLTNHETDFLHVIFQMHEEEVPVEIVAPARESLEIQHPPPLLEDEEPDFVPGEWDWNTVLEHRLGAGKTPHLGEPHKILSLQKHLEQLWSVLEVPDKDQVDMTIKYSSKARLRQLPSLVNAWERALKPIQLREALLARLEWFEGQASNPNRFFKKTNLSSSHFLEENQVRSHLHRKLNLMESSLVSLLEEIELIFGEPVIFKGRPYLDKMKSDKVEMLYWLQQQRRVRHLVSALKDPHQSTLFRSSAASL

SEQ ID NO: 790894 - protein, 276 aa, Homo sapiens
AGRAPGCLSNPSAFCSWTVAAAGSMMEPPKPEPELQRFYHRLLRPLSLFPTRTTSPEPQKRPPQEGRILQSFPLAKLTVASLCSQVAKLLAGSGIAAGVPPEARLRLIKVILDELKCSWREPPAELSLSHKNNQKLRKRLEAYVLLSSEQLFLRYLHLLVTMSTPRGVFTESATLTRLAASLARDCTLFLTSPNVYRGLLADFQALLRAEQASGDVDKLHPVCPAGTFKLCPIPWPHSTGFAQVQCSNLNLNYYQLAHKFYQKMIMMIILVREKLH

SEQ ID NO: 790895 - protein, 68 aa, Homo sapiens
ARSSPLTEFPRLDTPPARITMIQTLSVTDSLCIWLLLLSIMLSSFLLPSIPSCAYTTICLFLLLLLGI

SEQ ID NO: 790896 - protein, 104 aa, Homo sapiens
EKQKSQSTTFTHFPIYFVELTPETRSDWALLSFRMIYHSPYHSPSSRWRRKLSFFPAVPSFRHLVYRTPSPPFLSPMFWVALCPMLPKLILVALDAPLFLSNMF

SEQ ID NO: 790897 - protein, 86 aa, Homo sapiens
IPSSPTPAWGSPPCQKLERGKTQPTWEGLYRVLLTTEMTVGKGPIPGGILDLHSRINAFQINIQKGLICLFLLPVAAQGRLIINIR

SEQ ID NO: 790898 - protein, 103 aa, Homo sapiens
LLGLGNCRGSCPQSVCEDGTWWRTWEVATGNGRLIVKCRDLELFYHSLPTGWKSYEMTPARGVPTPSCDIGHFSSNTSLPTPLPIYKLKEGGPSRGRERATHS

SEQ ID NO: 790899 - protein, 146 aa, Homo sapiens [sequence omitted]

SEQ ID NO: 790900 - protein, 83 aa, Homo sapiens
CPGPGEGSQRRRNVPESGSGEPFSFHPPSAGALNRPGPLTMHLPSKKGPHACQGREPRPQGHSSLEGIPGTLNQHPAWFQQRH

SEQ ID NO: 790901 - protein, 100 aa, Homo sapiens
GRLSKGKQRTVCLFPPPTTTRAGGGNRPRGPDGPGAARRRGTPTAPPKVPLRMRRSGRRRPRQTARRHSGPVSVATGWWEGPGGAGALAAVPRGHVAMAT

SEQ ID NO: 790902 - protein, 42 aa, Homo sapiens
NWKLNRSVVILQHIENKDRRYHCYGPKPGLGIVCCQELELSR

SEQ ID NO: 790903 - protein, 73 aa, Homo sapiens
KKVTLSREMARAVGQAQTWALRSSCGVSIHLLQAQAWVGFILPGDRGGRCALLSSLAEVTRAELHFCGRRKSH

SEQ ID NO: 790904 - protein, 100 aa, Homo sapiens
CFVGLVVTARFSKLVSKSLASEPALPSQLLDPPGAQQTPSPSSDGERRRAWLSQAPIRSQGSPACLPTNPALPGLKNTEKGARLHLHPWHSGARSQGVLW

SEQ ID NO: 790905 - protein, 246 aa, Homo sapiens
HALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYVGVRRYLDKLEPSKVTKFENAFLSRVVSQHQALLGTIRADGKISEEPDAKLKEIVNKLLGWI

SEQ ID NO: 790906 - protein, 90 aa, Homo sapiens
IPVEGPTPPQDPAGAVDKDALRPRLFKPALLGGLELRSSQSRAAAGAFCRLSVDLELTASYDLEVDSEDRTVHLDIYSPFSHSLCLPWSR

SEQ ID NO: 790907 - protein, 96 aa, Homo sapiens
MHWRSHVRGAFGSRETAREPQWEPSGDPEDRIRGTARYLPTPLGHHSENQNQRYWGFPTGQERVLWIPLVRRAQPSDEESTPATQEEAQAQAGVAA

SEQ ID NO: 790908 - protein, 102 aa, Homo sapiens
RQPVSKAENLSQVTRLPGEKESGLTVPWLSHRAAVAFHLFHRLCRFSRLSLYVPVGVLGAKVHNVTLHTLLCLSRWDLQVSPASYLPLFPVSRVFAIYSFLQ

SEQ ID NO: 790909 - protein, 35 aa, Homo sapiens
MLVADPSTATQVSFHWSLSEQHSCHRVPQPMLRPH

SEQ ID NO: 790910 - protein, 481 aa, Homo sapiens
MAASWSLLVTLRPLAQSPLRGRCVGCGAWAAALAPLATAPGKPFWKAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 790911 - protein, 448 aa, Homo sapiens
MCATPPSLNFKKLAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 790912 - protein, 335 aa, Homo sapiens
MAASWSLLVTLRPLAQSPLRGRCVGCGAWAAALAPLATAPGKPFWKGIHRLKQSLPKRKPGFMAKSYDPIAPIAEEISEEACLLCFDEFQVTDIADAMILKQLFENLFKNGVVVVATSTGHRKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 790913 - protein, 209 aa, Homo sapiens
MCATPPSLNFKKLAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQGSWNIGWMAMDSGNRLFGKSGSKTGV

SEQ ID NO: 790914 - protein, 257 aa, Homo sapiens
TSQDTSLETGQGYEDEQDGWNSSSKTTRVNENITNQGNQIVSLIIIQEENGPRPEEGGVSSDNPYNSKRAELVTARSQEGSINGITFQGVPMVMGAGCISQPEQSSPESALTHQSNEGNSTCEVHQKGSHGVQKSYKCEECPKVFKYLCHLLAHQRRHRNERPFVCPECQKGFFQISDLRVHQIIHTGKKPFTCSMCKKSFSHKTNLRSHERIHTGEKPYTCPFCKTSYRQSSTYHRHMRTHEKITLPSVPSTPEAS

SEQ ID NO: 790915 - protein, 45 aa, Homo sapiens
LSLISLEKAATGTRAAHVHFVSNYFLGNQWINGSFFLFWETESGR

SEQ ID NO: 790916 - protein, 117 aa, Homo sapiens
MSEIPSTIVSKNMTNDKNSLESMNISSSSSTEENPKKQARKNEEHGPDPSANPFHLSGDVDFFLLRDQERNKALSVSIQDRRQHLRELPCSHCFLEWPHCPSQRSTFLRSFSFQNSQ

SEQ ID NO: 790917 - protein, 119 aa, Homo sapiens
VKLCTGRTLTNHPHYEDSSLRERTRAVYQIYAKRAPEEVHALLRSFGTDYVILEDSICYERRHRRGCRLRDLLDIANGHMMDGPGENDPDLKPADHPRFCEEIKRNLPPYVAYFTRVFQ

SEQ ID NO: 790918 - protein, 283 aa, Homo sapiens
KNENGAPEDEENFEEAIKNVNTALNTTQIPSSIEDIFNDDRCIKYHQTDSIILDFSSALKEFVAKEGQGNLPVGGTIPDMIADSRRNILNSQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 790919 - protein, 64 aa, Homo sapiens
MPSHNVVTRPAHSLSVPAYCQALKRMKRNCTFLRRRCTSVMMGCRNTRYHSSCGTPQPLTARGR

SEQ ID NO: 790920 - protein, 107 aa, Homo sapiens
LQGPPGLPGRISPGVPLTPLATCHASSAPGIWNLELQRLEGPRTLALLRPACSCHTSSKVPSSRKSSLTTANAHTYAHIHACTWDKYVFFLAWSLCTLSFPALSTNN

SEQ ID NO: 790921 - protein, 71 aa, Homo sapiens
MKLSHEKPYKRSTKPKAGPLKKMNKIDRPLGRLISKREKIQGQAQWLTPVIPELWEAKMGRSPQVGTSRPA

SEQ ID NO: 790922 - protein, 102 aa, Homo sapiens
MLQCHSFYRKDVQVEHPKSLNPKYSQIENFLSADMALKRKCLLSISDLDFWIWDAQPVGIMQTLQNLKKIPNPGCFWSQAFQIRDTQPILPLGGRYYITIRQ

SEQ ID NO: 790923 - protein, 356 aa, Homo sapiens
SHNFARVSWLSAAPIHCPRASIHLSGRLSSERGSRPGAAATRGTEARRGAKSAADPCGPGQGTVAAAMQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGVG

SEQ ID NO: 790924 - protein, 212 aa, Homo sapiens
MGGGTGPPQRASVLLRGRSSPVPAASGAMGTGLRSQSLREPRPSYGKLQEPWGRPQEGQLRRALSLRQGQEKSRSQGLERGTEGPDATAQERVPGSLGDTEQLIQAQLKRQPVVAEAVPTGKKKVGELCRHLPQRDSESAGLPVAHTGHHQLKMLEAIVAPLLCLDQPTVSADLPLHSSLDFGWVALGGFCHQLTGVATWLPLLALALPLQH

SEQ ID NO: 790925 - protein, 187 aa, Homo sapiens
MIQKQNLIYAISVCLSVPMGLAQPLEAQPRVRQGTGTARWHRVTGCGPVAEHAVVLSLILFSFVLFFLFFLFLTPASFAFYLTKAKTIARWLVGQPGREDPGLGFSNLRPFLQPSPPPAPPSISCRDPRRWSHSFTIAPNPGILGGLHSHHHTLIPCFLPKSHLSSLPRRYRGRAQTTTAGHDIALK

SEQ ID NO: 790926 - protein, 43 aa, Homo sapiens
MRINLAWERNTIESKKNGNHEYRVLTEDIQGYAKRSPQDNSLG

SEQ ID NO: 790927 - protein, 61 aa, Homo sapiens
DGPRHRARSGLGFTVAGAHISCTLTAMLMCPEGRSLPLQFPDIGTCCPYVWPLMHLLLLEL

SEQ ID NO: 790928 - protein, 130 aa, Homo sapiens
SLSVGSCVIIKGTLIDSSINEPQLQVDFYTEMNEDSEIAFHLRVHLGRRVVMNSREFGIWMLEENLHYVPFEDGKPFDLRIYVCHNEYEVKVNGEYIYAFVHRIPPSYVKMIQVWRDVSLDSVLVNNGRR

SEQ ID NO: 790929 - protein, 108 aa, Homo sapiens
MSNPTCISVFNHLESRRAWAAKQKDSEGIFSPASSQVSGLQVNTYAEDLTLFNSLQRHSRKVQCRKEKREREQKGGREELVEGREGERGKEGRDGGRGRWGRESLLPR

SEQ ID NO: 790930 - protein, 196 aa, Homo sapiens
EQSGRGLLPPVAPSWLDLAGLGVMPDTFNSRSPSVEGSLWAVGTESQGRDWRHLPTITSELSGAPRCHTVPCAGSTALQEPGEPQGPPASPSCPEEALAATWEQPWASEVFGPERMPPSGAARSFQEVTEPAVVAVDRQAIFPDTWDSHGGTWPTAGEAKARAREAGKQLPCLSYHGAARCKDDREGKCGQANPGT

SEQ ID NO: 790931 - protein, 209 aa, Homo sapiens
SGTAPASLACTVGSLAPVASCLLRARLPLTEAAMAAAGRGREQDSARFVYVTRFGSHQCSGVLQLGGRGAQGLWGQGPGAGCRQEKPREAMAVAGVQGGSELPLGSQLRVPTTPGVEAAASASSQLRASRVQSGTRQSARAGLIQKDAAKKYDFPIPLNEASKIMKKKKKVLVWNRVYKVISRMLEENEKYRHRLKCQRLSSESSNYTR

SEQ ID NO: 790932 - protein, 135 aa, Homo sapiens
GAASGTPDGSGRGRRRRRRGRGAALRRGSRGLLGRPAPPAPHVGTEAEGEGKAAGKGRAQWAQWGRPGPGGEARGAGQEGPGLRKRLEGEGSIRMAGASLRIAFSRHLVSSVTGARSRELSSLRAWDGARWRGGR

SEQ ID NO: 790933 - protein, 139 aa, Homo sapiens
MGLAASGAKEKHPTNQGEEGSRPPHGRKLRSERQGWAGPVLGALQTPDQGRLSSPREGPVHGRSQPHRADCTGDAHEDSRPLRTQLSRHRSPSAKARVQIMQTEARLPWTPEPQTPSTKAKWTHLHQIHHKDGLRDSVS

SEQ ID NO: 790934 - protein, 114 aa, Homo sapiens
MNHSPRKCVPAETIASPAGRTQLPLPSSEHRLYKYLGLLVKYAIDAVFFKSLKVSFMSTLLKLISGVFRDFLCLATCAALLNAHYSSVCLGSYVTLVHFLPLLSGFTGLFPFQK

SEQ ID NO: 790935 - protein, 120 aa, Homo sapiens
NEWRAAATAAAGPAARAAPPPSLREEEASRRFVPTKPRSKQLENNCMSSGLGLSDSISKLPEERHIDTGEVRAFELQCHPRHPPPPPAPPPNGTLDNFSLSCDFCHFLRQLEPAPLKSIF

SEQ ID NO: 790936 - protein, 260 aa, Homo sapiens
AEKRDTPALSEGFRTEGKKLRRVVRLPARRGHFSWALPELSRDLCAPSGRLPRPGLGTTSGVGCKESLRLLPPASPPLGLGGSPPAPARSALPGTASCPETATMNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRHSLEEFLNCCFNTRHDGVQPGRLI

SEQ ID NO: 790937 - protein, 680 aa, Homo sapiens
AEKRDTPALSEGFRTEGKKLRRVVRLPARRGHFSWALPELSRDLCAPSGRLPRPGLGTTSGVGCKESLRLLPPASPPLGLGGSPPAPARSALPGTASCPETATMNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 790938 - protein, 45 aa, Homo sapiens
KSKLLQVIKWQSWDSSCCRPDSKPILFTYSIVSREIRLLGLNYVK

SEQ ID NO: 790939 - protein, 45 aa, Homo sapiens
MLGCRMEACAAQMDSACTAVTPDCIWVASIHAHVAGTVRLPPGQT

SEQ ID NO: 790940 - protein, 100 aa, Homo sapiens
EEPSKMGISTVILEMCLLWGQVLSTGGWIPRTTDYASLIPSEVPLDPTVAEGSPFPSESTLESTVAEGSPISLESTLESTVAEGSLIPSESTLESTVAEG

SEQ ID NO: 790941 - protein, 101 aa, Homo sapiens
KPPDSFVIFCKVSSQLFIQEKDTLKSLTLCHSIERDMYYKIYNKIWKQRSYIYSFFLLRDEMLLCCLRCLELLGLSNPLTSAFQVAGTTGMSHCSQLIFAL

SEQ ID NO: 790942 - protein, 218 aa, Homo sapiens
MFISLSRNKCKGRVLANTKFCPWNQFHFMKLCCQSKQPLPVSRPDSVNYSSAAQPALSPLLSFLRLLGASASVTGLPFGMAVTHAHRWQSGKTPGLTPDALRTAAELANWVQLALKRIYAEQTAPWPPQVPAGAGISTHHSSEWNSGKGLCPPWLPGSTSLTVCGCRGGQFPHIGDLEVPSLQGDSAGHTSPGRGPGDITRDTPGRLLSAQLGFTVAF

SEQ ID NO: 790943 - protein, 110 aa, Homo sapiens
MGNGQVKMRIAKNYTPTNRIVVILSLRLQEKLYTGGRIFYHFGMLPKKWDTKGVNFRSLEVAKLEGDLWRHDLQFFLRSIKLKRKEKANSACAWILDLALIQTPLLECKP

SEQ ID NO: 790944 - protein, 62 aa, Homo sapiens
KLQPEITKSPYSSASELFKNHFRDTMITERYTKHGDGRVKTASLDFTSSQSSTALRSVTSNT

SEQ ID NO: 790945 - protein, 97 aa, Homo sapiens
ASAGDSSEGCLLTCLAVNATSQLGPHKGSWRHTAPGLSVWLGLPHSMEARSQEQEPEPAASCITSLPLSQRNQPATCAVLCFPACLPVFLPLSFLPS

SEQ ID NO: 790946 - protein, 141 aa, Homo sapiens
GLCCEMAEKQETRWGGGHPPEIEFQGHCLCSHRANTRPLFPGPCGRGASGCPFRQCGPQTRRTGLVLLASRPPATPFTRSLGPSLHPQCLPRPSQQGGWASPHVHGFESRRRTGCQDRGSALSARSGSAHPRGGGADVLPG

SEQ ID NO: 790947 - protein, 104 aa, Homo sapiens
MDCSPRSRISVRGYPQLPLRQIREWGRPSKPGSSAKMPPLSLACLAQVPAAPRSSPQVPHLRSAPADGAAASQGLRVRGRLRFRPGKRVSRVGARRTPYSGLRP

SEQ ID NO: 790948 - protein, 134 aa, Homo sapiens
FEFIPFHSSPFHSSTLHSIPLLSGPFNSTAFHRCPFHCIPFHSIPSHPIPSIPIPIPIPLYSIPFESILFHSIPFYSSTFHSIPFHSIPFHSIPFHSGSFHSVIILFHSSPFNAIPFHMSPFNSIPFESIPFHS

SEQ ID NO: 790949 - protein, 118 aa, Homo sapiens
VCSPMSSLVGYYVLILPMVIHPLEGSLTLWSWSSKYSKRRQAPVHKHSSSLCLRYMYLISTKANHIAKLRVGVGGSCPRVQIEKEEESVAIFVISHRWPGTLAPLRLKSPVECGDSRL

SEQ ID NO: 790950 - protein, 92 aa, Homo sapiens
LKLQNLMLCALQTVNGAEAGKESRGAHAGEDYKVRLLATPTCTCLFLPPGGTQPHPCIFSAFYVVSPKVYPKNAFFPLVTLIPGFSPFSGSL

SEQ ID NO: 790951 - protein, 157 aa, Homo sapiens
MPPLSWLAQWAHTGAVVWVFLPPVSQCSWWPCSGLSCHRLSPPGGQMGRWAALPARDTGLAQPTVSKERRVEGAALYRSHLGLMLCFAGITHVDIPCVLLFLPCWYSPRVAVPPVSLFPPCRCSPRVAVPPVSLFPPCRCSPRVAVPPVSLFPPCRC

SEQ ID NO: 790952 - protein, 128 aa, Homo sapiens
MNHSALMFQFYTAFLASRICFNAGMATALLENYLKDQKGPGEAYFLGFSSWTRKEWFHSASRRSWSLSLSASGSCLLCFGSEEVSDSFDTSGNLNQAVKPRPPCVKIKVVSLWLHQDVCVRLSQQGGE

SEQ ID NO: 790953 - protein, 32 aa, Homo sapiens
GKSFMYNYRLMRHKRVHTGERPYECNTCGKFF

SEQ ID NO: 790954 - protein, 105 aa, Homo sapiens
NPSDSRCIGEKYRLKIIGYPSRKEIYEVWVRPAVISLKLLIVEPLQDYRLFLSGCQAPLREAGELLNAQVYPAGGTGILLEALSGHALIPSISTVAIPSRYWSPL

SEQ ID NO: 790955 - protein, 79 aa, Homo sapiens
RPLPMPQFLTGLLGLHPTACFSSSPSSGQHWDDECHEPGHFTPLPCTAQWGVEAVALDACTRLPRFWPLPPPLAPNPQP

SEQ ID NO: 790956 - protein, 174 aa, Homo sapiens [sequence omitted]

SEQ ID NO: 790957 - protein, 69 aa, Homo sapiens
YKGNSKDVNLRISGIIHERLELNPIDKSPDQNPIMTDTPIPRNSQDITPVDNSMGQQYPSKAKFIQKDR

SEQ ID NO: 790958 - protein, 106 aa, Homo sapiens
FSLKHVIGASREGKVAKLFCHCARSKGMVSMLSFPQKGKNTSNWRPPTTGLEGTLRQQSEVMKSQTQDSGCLGCLLILPFLNRMPWARPQSHCCPCTRRLILISIV

SEQ ID NO: 790959 - protein, 133 aa, Homo sapiens [sequence omitted]

SEQ ID NO: 790960 - protein, 112 aa, Homo sapiens
WAAKQIIGNNPGAWQGNRCTMERTLPDTEDKSSEGTEQVTPRAAQRCVSCSHGSQSLCSNCPPAGLSPVPSAWAGVWPLAEPWRPALLPAPFQPGAARGRSIPGAGLSPVVG

SEQ ID NO: 790961 - protein, 133 aa, Homo sapiens [sequence omitted]

SEQ ID NO: 790962 - protein, 133 aa, Homo sapiens [sequence omitted]

SEQ ID NO: 790963 - protein, 75 aa, Homo sapiens
MKNEILCLKEDIIWWIYAPKRYLNPTSMLLDEHFKDLIGWVRWLMPIIPALQEAKAGRSLELQTSLGSIAKSCLY

SEQ ID NO: 790964 - protein, 57 aa, Homo sapiens
MSPLTKGRQAIFGCSTWIAEALNLDRGAPNPDRGAVSLGSSLSGEGWRGGHFFTLCA

SEQ ID NO: 790965 - protein, 304 aa, Homo sapiens
PPPPASGSNLRGSLTLWDLCSFALHNKSPCCSLFVSVSSLRAVTLTRKMESRSGIQAGVRCRDLGSLQPPPLALKQFSSLSLPSSWDYRRLPPRCGFLFEVSETTNPPAGTNSRHTLTVKLDGLAKIRTAREAPSECVCPPGTPGRRGKPEEKRRPGPPGTLGRMASPDFQARTGEKGAPRRLWTTGETKDTMELHGPHGAPWNLLGPGDLLATLGKDGPRGNHKGQRAPKESRKRRRDGPTGPQGPRVSMEYLDRRCNHGDTRPARANSGHRRAMEQEARGDERCGRCPGRRGTDPEARSPDG

SEQ ID NO: 790966 - protein, 143 aa, Homo sapiens
PPPPASGSNLRGSLTLWDLCSFALHNKSPCCSLFVSVSSLRAVTLTRKMESRSGIQAGVRCRDLGSLQPPPLALKQFSSLSLPSSWDYRRLPPRCGFLFEVSETTNPPAGTNSRHTLTVKLDGLAKIRTAREAPSECVCPPGK

SEQ ID NO: 790967 - protein, 117 aa, Homo sapiens
IYAPNTTAPGFIKQILLVLQRDIGNHTIIVDFNTPLMILERSSRQITNKDIWDLHLTIDKIELTCIYRKVHSTKAEYKSFSSMHDTYSKIDYMLSQKFSIISKKPKSYQPHSPTTAQ

SEQ ID NO: 790968 - protein, 278 aa, Homo sapiens
LSVALRLLAELTFLGGQALLYGFRVAPHFACAGPPCPHTVDCFVSRPTEKTVFVLFYFAVGLLSALLSVAELGHLLWKGRPRAGERDNRCNRAHEEAQKLLPPPPPPPPPPALPSRRPGPEPCAPPAYAHPAPASLRECGSGRGKASRPPAAEIWPSRGGHRLARTGRRGPDPATSARTAEAGSCFHQSCRGTCPGRRRVVGTARGRHRTCLVLPPSGCRQAPGAGQGWGQENELRQVLDATTQVERKETRTLRESGPEGENRAEGGEWLFYWGQKQL

SEQ ID NO: 790969 - protein, 69 aa, Homo sapiens
GSSCNDIARLSWLHLLEHKSFMCPIFLASPETPVLTAPPAKSLSSLWVHHAAATFSWPASPPWGSLHSR

SEQ ID NO: 790970 - protein, 119 aa, Homo sapiens
MISHSYSCLDPYFTEDQDLKLPLAIHCKVYFFSLRKLFFIFFRDWFSCTPPRLEYSDTIITNCSLNLLGSSAPLASTSQLLGRLRQENGVNPGGRACSERRSRHCTPAWATEQDSVSKT

SEQ ID NO: 790971 - protein, 67 aa, Homo sapiens
ASHQGASNRCKDWRTLRDEHVQEAPGLCTHRKDHVRTQREGGHPQAKEKGLKNKQICQHLDFELPAS

SEQ ID NO: 790972 - protein, 118 aa, Homo sapiens
REGGQSTVNAPEVWQIRPTLSARLGAPDLHWRETAKARGRRGRSLVPCSYCSRGVPAYPPGSAGAHLAPPGTDEIPRAPERARSSLCYTKSERERSPGGSEQRIHPACLREIKFNCDL

SEQ ID NO: 790973 - protein, 119 aa, Homo sapiens
AHRCCNRNRIEERSQTVKCSCFSGQVAGTTRAKPSCVDDLLLAAHCARRDPRAALRLLLPQPPSSCRDGGVRWSPACRGRSVRCSRTCRDGAAAVDTKSKPPRSHDSSWGSRPGQERLD

SEQ ID NO: 790974 - protein, 118 aa, Homo sapiens
LISLAFPHMYLSHNPLKHMQKTTDLIASLLIKGCQRCVQLSGYDPAILFLPLSEEQSHTLLVCDLDWQVAMTDFIGNISFHLPASKLLNFLQTVPVKFVSIVVSEPFTSCHHCLYRWL

SEQ ID NO: 790975 - protein, 67 aa, Homo sapiens
NPTAFSALRCGLDFHVNLKSVLKSRLPPRVYFGGNFTSLQQESFQPRNVVRFRIYSDLPSTPLNFLH

SEQ ID NO: 790976 - protein, 107 aa, Homo sapiens
MPSFQSTESPDKSTPEDECCNVQLLKNLRKCLSLNSHRRSPFTKVALSSAGARSTGGTCAMCRVIPLFPGAGGTCAVCRVIPLFPGAGGTCAVCHVIPLFPDTGGTC

SEQ ID NO: 790977 - protein, 113 aa, Homo sapiens
MPFRAWTAAVAAPGAMSPLATGGLTACAQAGSGSPRVRGSPRVRGQEGAHRVCTGRQRLTPCAWVTPCAWTGGGSPRVHEHRVLVEPVIHADLQVHAGLRHPDRHIDGHAHDP

SEQ ID NO: 790978 - protein, 122 aa, Homo sapiens
MLACAWLAPGHGYGVPQGIWRQERIMERGLYVSPVASGLDKAQRHLKDTSRAFQQRCHICLRIAAPGPHTQFTQEGSREALPGVVWWWYAGVGGNHSWRTNCAKTMEPAVSCPGSQASSVAF

SEQ ID NO: 790979 - protein, 101 aa, Homo sapiens
RWDGYPAGRRRSWASFAMQSTDLGNKESGKIWHRKPSPATRDGIIVNIIHNTSDYHPKVLRFLNVAFDGTGDCLIAGDHQGNIYVFDLHGNRYLAKYCHKC

SEQ ID NO: 790980 - protein, 189 aa, Homo sapiens
RWDGYPAGRRRSWASFAMQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQ

SEQ ID NO: 790981 - protein, 67 aa, Homo sapiens
PQGTGCRKVVKGPKDACVASGSAGRKPESESENFSRFTFLRGRQTVFQSSCLIVPSHSVSVHPYSHT

SEQ ID NO: 790982 - protein, 111 aa, Homo sapiens
RTLPTPHPRHLIPKEEKSTSKAPASSLENYPLFSFLASPPGEWKPLAHSIEPDSNPDDPENLYGDRQGGREERAKSSLQGRWRLRKPRARRSRPPPAARPRRAAALAPGLA

SEQ ID NO: 790983 - protein, 145 aa, Homo sapiens
AARECLCTRLWPAHASCGVGRLGADRGVCGGGVRGIALGARVCVCVCECPRGCACTGLCLARGPEGNNARGAPPEGSWAAPRGTRDCRQPGAEVQLPPASRSRGPVWHFPPWSEAFSVSGATGAGPRGPTPQVLCLGFERSPRGG

SEQ ID NO: 790984 - protein, 610 aa, Homo sapiens
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 790985 - protein, 610 aa, Homo sapiens; identical to SEQ ID NO: 790984

SEQ ID NO: 790986 - protein, 610 aa, Homo sapiens; identical to SEQ ID NO: 790984

SEQ ID NO: 790987 - protein, 162 aa, Homo sapiens
SLAYELRRIGALTAGPAPPGLLRFREVHSPAAAAPARCPLRPASRGRGDSAPGRGLRWLQLPMGKTGSRVSVHRGSQTLQDPEIVWDPHQSEEKKNRKRRDSPPLQAPSCRTLNRMMLKRIWRFMQVTSLRNFSIECTMPWVSRFPLKIPWLTLFFYHYLGR

SEQ ID NO: 790988 - protein, 43 aa, Homo sapiens
MSLVSLKCMKPGCARPPWARHQDFLRLCHRRVSSTLANKPPKM

SEQ ID NO: 790989 - protein, 157 aa, Homo sapiens
TSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVDAAANLVVVVGGR

SEQ ID NO: 790990 - protein, 121 aa, Homo sapiens
AIWRGLGESSERILPQGPPNPPPESYQRRTHVGALELLFKFVSLPFQATRCSAGKNFKWLKQRIWGRCHWVPFSCLLQFLQTSLHPRQLRFMQRFRSPWEEPEGCCLFLKSTLLAAVVMSK

SEQ ID NO: 790991 - protein, 47 aa, Homo sapiens
MVRSSTRMSPTWASKLAAAAGRARGGGDVPASTVPSSLPAVLGRGAR

SEQ ID NO: 790992 - protein, 237 aa, Homo sapiens
HEGFRSSAITNTGVFQHILCNFELWMNTADNLELSLFSHLLEILQSPREGPRNAEAAHQAQLIPKLIFLFNEPSLIPSKIPTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMGEH

SEQ ID NO: 790993 - protein, 73 aa, Homo sapiens
EVGQDSVIQSLPQSRQVRSHHGQLALADVAELSWGRGLRAPTVDFSTWVGPLMARVPCSKQSFPRMSSQKRRY

SEQ ID NO: 790994 - protein, 123 aa, Homo sapiens
MVRNVDDLDFHLPSHAQDMLDGLQRLRSQPKLADVTLLVGGRELPCHRGLLALSSPYFHAMFAGDFAESFSARVELRDVEPAVVGQLVDFVYTGRLTITQGNVEALTRTAARLHFPSVQKVCG

SEQ ID NO: 790995 - protein, 160 aa, Homo sapiens
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVS

SEQ ID NO: 790996 - protein, 129 aa, Homo sapiens
GVPLLGSMGWDKAGAGFLHPKCPGACVPSLLTVGPGQSARSKAGGLAPPPGANTRAGCVLRGARGLPLGTSRVQGSPRARPKPSPSAPGARARAHPPAPRPCARAGLGVGSPRARPPEFPRSGPGSGGR

SEQ ID NO: 790997 - protein, 112 aa, Homo sapiens
PHPPIPSLAPAPSTGPPRAGLTWGSSLRPAGCWGCWQFLRPAHVGATVCKGQARAGAVYPELHSLHGTSMSLKHLLPMEVTPACGLALLRLFAAKAPVPPARSAAHRPCPSP

SEQ ID NO: 790998 - protein, 155 aa, Homo sapiens
LHLGDQSSFHFFERNEHCLHTNNGRKILVFPKQPPQATQEPNSGEVRKIQEVGIAAQRQHRAALTRPQRQHRAALTRPQRQHGAALTRPQRQHRAALTRPQRQHRAALTRPQRQHRAALTRPQRQHRAALTRPQRQHRAALTRPQRQHRAALTRP

SEQ ID NO: 790999 - protein, 102 aa, Homo sapiens
MCFPMAHPIDGAPYPRLSSLRKPFKEGRLIVFLSPLIILPSSAPAATATATAAVEVGAVPSASSKWLLQASFRAGVPVSSASSCGFPPSKVTGFTHPFLPQP

SEQ ID NO: 791000 - protein, 602 aa, Homo sapiens
SWGWLSAGECERECAHAAGASLPSPRTLLRASEEPGNVNRLEVWHVAKMVSAKKVPAIALSAGVSFALLRFLCLAVCLNESPGQNQKEEKLCTENFTRILDSLLDGYDNRLRPGFGGPVTEVKTDIYVTSFGPVSDVEMEYTMDVFFRQTWIDKRLKYDGPIEILRLNNMMVTKVWTPDTFFRNGKKSVSHNMTAPNKLFRIMRNGTILYTMRLTISAECPMRLVDFPMDGHACPLKFGSYAYPKSEMIYTWTKGPEKSVEVPKESSSLVQYDLIGQTVSSETIKSITGEYIVMTVYFHLRRKMGYFMIQTYIPCIMTVILSQVSFWINKESVPARTVFGITTVLTMTTLSISARHSLPKVSYVTAMDWFIAVCFAFVFSALIEFAAVNYFTNIQMEKAKRKTSKPPQEVPAAPVQREKHPEAPLQDTNANLNMRKRTNALVHSESDVGNRTEVGNHSSKSSTVVQESSKGTPRSYLASSPNPFSRANAAETISAARALPSASPTSIRTGYMPRKASVGSASTRHVFGSRLQRIKTTVNTIGATGKLSATPPPSAPPPSGSGTSKIDKYARILFPVTFGAFNMVYWVVYLSKDTMEKSESLM

SEQ ID NO: 791001 - protein, 258 aa, Homo sapiens
SWGWLSAGECERECAHAAGASLPSPRTLLRASEEPGNVNRLEVWHVAKMVSAKKVPAIALSAGVSFALLRFLCLAVCLNESPGQNQKEEKLCTENFTRILDSLLDGYDNRLRPGFGGPVTEVKTDIYVTSFGPVSDVEMEYTMDVFFRQTWIDKRLKYDGPIEILRLNNMMVTKVWTPDTFFRNGKKSVSHNMTAPNKLFRIMRNGTILYTMRLTISAECPMRLVDFPMDGHACPLKFGSCLSKSEMTILDLIGKPFK

SEQ ID NO: 791002 - protein, 542 aa, Homo sapiens
RLVSRPVTVGMLNDAPNLNESPGQNQKEEKLCTENFTRILDSLLDGYDNRLRPGFGGPVTEVKTDIYVTSFGPVSDVEMEYTMDVFFRQTWIDKRLKYDGPIEILRLNNMMVTKVWTPDTFFRNGKKSVSHNMTAPNKLFRIMRNGTILYTMRLTISAECPMRLVDFPMDGHACPLKFGSYAYPKSEMIYTWTKGPEKSVEVPKESSSLVQYDLIGQTVSSETIKSITGEYIVMTVYFHLRRKMGYFMIQTYIPCIMTVILSQVSFWINKESVPARTVFGITTVLTMTTLSISARHSLPKVSYVTAMDWFIAVCFAFVFSALIEFAAVNYFTNIQMEKAKRKTSKPPQEVPAAPVQREKHPEAPLQDTNANLNMRKRTNALVHSESDVGNRTEVGNHSSKSSTVVQESSKGTPRSYLASSPNPFSRANAAETISAARALPSASPTSIRTGYMPRKASVGSASTRHVFGSRLQRIKTTVNTIGATGKLSATPPPSAPPPSGSGTSKIDKYARILFPVTFGAFNMVYWVVYLSKDTMEKSESLM

SEQ ID NO: 791003 - protein, 151 aa, Homo sapiens
MRKRTNALVHSESDVGNRTEVGNHSSKSSTVVQESSKGTPRSYLASSPNPFSRANAAETISAARALPSASPTSIRTGYMPRKASVGSASTRHVFGSRLQRIKTTVNTIGATGKLSATPPPSAPPPSGSGTSKIDKYARILFPVTFGAFNMV

SEQ ID NO: 791004 - protein, 68 aa, Homo sapiens
AAQGKESSTCSQDTSEEAVCVLQKNLGINGRGAARQRDQPVQRLRGSKVHVRYPLAKKLTFQKGVLRQ

SEQ ID NO: 791005 - protein, 73 aa, Homo sapiens
LAGDERLLPPGRKDIGAPQARSPPQFLGPFLLPLPARADDTENRILRPTQEQLGEEHQKFNAPWRCIPRALPA

SEQ ID NO: 791006 - protein, 73 aa, Homo sapiens; identical to SEQ ID NO: 791005

SEQ ID NO: 791007 - protein, 205 aa, Homo sapiens
PGSAPRRRGGREGWRVEPETRDPVPAHLPVPRSFGRRHWQEMKGCCRPVGRTSAPPRPGPRPSSSGLSCCPCLRGPTTRRTGSCAQPRSPPSFRGPGLDPAEPQMCEQERQSPDARPAGSGREMVPSFCPEGEPCTEGPLRAWHCLPNSPSASLPGWAMRGLDRIALVPSWQWVWVGSWGQGFPECRQLGLHLPRPPTQAQISRA

SEQ ID NO: 791008 - protein, 110 aa, Homo sapiens
SSHCLLLSDLTEVRVIKAWGTGTGLRGVLSPSVFQPRGDSACLGRWKGFLRAHHLPPPCACPLLGPGFSSDYSPCCFPHSGEHRALPRGLNLAPQGSGITQKTGDSQGGS

SEQ ID NO: 791009 - protein, 230 aa, Homo sapiens
GRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 791010 - protein, 108 aa, Homo sapiens
AVLNFLLVYSLWAEMPLASPTLPCAHCSAPLASALGSPPATLSTFPSHQQPGLCPTRLVLKGGLLTGIVSRQPPITRAQVVFLRNPNFYVFLRPPLSLSPKLECGGAI

SEQ ID NO: 791011 - protein, 106 aa, Homo sapiens
ISEDDQRSLLSPFWFWWVLADFFTATCFISKVFMTCILCPHPISSCKLECLNLLGMQPSRSHSALFYLAPFKMELLWFTCLGQNHCTWDIHHVKDLSFLYARPLEF

SEQ ID NO: 791012 - protein, 103 aa, Homo sapiens
MLCRFRAVEAVHGPHRNAPKPGHRKHRRTDPDPGPGPARLQGRAPHIDKDTGAAPRRQEGCEELPLYSEPDAAYGTGPPRLGLAGCRAARHAWVHPAGAGCGR

SEQ ID NO: 791013 - protein, 74 aa, Homo sapiens
SPDISHLSLCDQPTWRGERTRSCFSGPPASGHVGDTWAPVDLSELLGEDLNGENETQASAPNSYTRGAEAMPLA

SEQ ID NO: 791014 - protein, 90 aa, Homo sapiens
ILKEGLQGACPGSCASEGWKEVAFYSGERWRVGAFASQNTSPSQLPMHLPNPAIKLLTHPAPTGVYTTDNARVQIPTPDSPLTGCVTLEK

SEQ ID NO: 791015 - protein, 192 aa, Homo sapiens
ARGWPSSASPPLPLQVPCTQASVHAARDSPRFPSTPSPASQSRRFCSWLPAHAWVPSSATSLQGPMPCALPVPVCCGATTPIAVNSKGSPREPGARDGILLCCPGWSRTSGLKRSFCLSLLNCWDYRCEPPHPARFLIFNKDSLWLCEEKVPVLNGGRLGPPRQEMVAAVAMLGAQAGTGRNSRGTPGLGLE

SEQ ID NO: 791016 - protein, 478 aa, Homo sapiens
MAASQLAALEGVDSGPRVPGASPGFLYSEGQRLALEALLSKGAEAFQTCVQREELWPFLSADEVQGLAAAAEDWTVAKQEPSGMAEGATTADVDAGSLSYWPGQSEQPAPVLRLGWPVDSAWKGITRAQLYTQPPGEGQPPLKELVRLEIQAAHKLVAVVMDVFTDPDLLLDLVDAATRRWVPVYLLLDRQQLPAFLELAQQLGVNPWNTENVDVRVVRGCSFQSRWRRQVSGTVREKFVLLDGERVISGSYSFTWSDARLHRGLVTLLTGEIVDAFSLEFRTLYAASCPLPPAPPQKPSVIGGLQRGRSLHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRSPWGGALPLPPAHRLRYLSPARRRFGGDATFKLQEPRGIRPSDWAPRAGLGGQP

SEQ ID NO: 791017 - protein, 163 aa, Homo sapiens
MAASQLAALEGVDSGPRVPGASPGFLYSEGQRLALEALLSKGAEAFQTCVQREELWPFLSADEVQGLAAAAEDWTVAKQEPSGMAEGATTADVDAGSLSYWPGQSEQPAPVLRLGWPVDSAWKGITRAQLYTQPPGEGQPPLKELVRLEIQAAHKVGCRGGPV

SEQ ID NO: 791018 - protein, 478 aa, Homo sapiens; identical to SEQ ID NO: 791016

SEQ ID NO: 791019 - protein, 294 aa, Homo sapiens
ISVLTWAVFTPPLPSRYFSCAHSTDREAEAGEVRTRLRSYGLPWDLAEDGGRAGPSGLETLTPYSPTPSFTWSDARLHRGLVTLLTGEIVDAFSLEFRTLYAASCPLPPAPPQKPSVIGGLQRGRSLHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRSPWGGALPLPPAHRLRYLSPARRRFGGDATFKLQEPRGIRPSDWAPRAGLGGQP

SEQ ID NO: 791020 - protein, 505 aa, Homo sapiens
MAASQLAALEGVDSGPRVPGASPGFLYSEGQRLALEALLSKGAEAFQTCVQREELWPFLSADEVQGLAAAAEDWTVAKQEPSGMAEGATTADVDAGSLSYWPGQSEQPAPVLRLGWPVDSAWKGITRAQLYTQPPGEGQPPLKELVRLEIQAAHKLVAVVMDVFTDPDLLLDLVDAATRRWVPVYLLLDRQQLPAFLELAQQLGVNPWNTENVDVRVVRGCSFQSRWRRQVSGTVREKFVLLDGERVISGSYSFTWSDARLHRGLVTLLTGEIVDAFSLEFRTLYAASCPLPPAPPQKPSVIGGLQRGRSLHRVSRRRSVAPASPPPPDGPLAHRLAACRVSPATPGPALSDILRSVQRARTPSGPPARPSRSMWDLSRLSQLSGSSDGDNELKKSWGSKDTPAKALMRQRGTGGGPWGEVDSRSPWGGALPLPPAHRLRYLSPARRRFGGDATFKLQEALCLNALPWTRLLASASVKQKGCLSLVLQLGPGVVAHACNPCTLGG

SEQ ID NO: 791021 - protein, 84 aa, Homo sapiens
VRASRLLCLPKQAWAMAGAPPPASLPPCSLISDCCASNQRDSVGVGPSEPGVGYSLVLRRFLSRSEKRNIRVGVTRFSRWEVGR

SEQ ID NO: 791022 - protein, 102 aa, Homo sapiens
INEICVRSRKGRTYQEKVKRIPKVHIRKVRGKQPHAREKSSQQAPVCLGVSSFSTESPTPRETPQSWANQDGWPPYTTNCPCGEQEKRWLQEQTFRKKNEIR

SEQ ID NO: 791023 - protein, 180 aa, Homo sapiens
GRESPALRPPAEAEEEEEDEEVVVEVVDGDEDDEEDEDEEGGSRRRRGLGRVEEKPRGGAEEEDDDEEEEDEEVVVEVVDGDEDDEDGEERFVPLGPGHAVPRGPARGALKVGSIKREMTFTFQSEDLKRDCGKKMSHQHVFSLAMEEDVKTADTKKASRILDHEKENTRSICLLEQKRK

SEQ ID NO: 791024 - protein, 78 aa, Homo sapiens
GKKKERGKKKEEEEKKRRRREEKKKKKKRKRRRNKQSVPRAQKDHTCWTGLQALGPILMKKISVQTFASWALHDCAFQ

SEQ ID NO: 791025 - protein, 117 aa, Homo sapiens
GLPAAWARGQNPSERCLGPPLHGATPWNQTETVTPCRDGETEARAGGWPQIPPKVGHPMFNCRAPLLGLSGPSHLKPGFLGGKKSTAFSGPGRRPGAGDDVSLSEKERRGQSKRRQP

SEQ ID NO: 791026 - protein, 147 aa, Homo sapiens
VTAAPRGGHLGRPRQSGGRVSPAPGTRTRASTRVTAGLPSSIGKERSVSSHPPPQARGAKVTGRAARAAESIGIEIPLLVCREFYVGVKSPSGHGLARVGPAFPPPRLGVAWPLGVENWPRPMGQGGGEVRLPHSPLEIPFKETHYE

SEQ ID NO: 791027 - protein, 98 aa, Homo sapiens
GGAGAGDQGVRGGRGCDGEFETVRTGQRRRADRESRADPQVTGTSDSSREGDTDHGKPSEARDAGLPGFHVRSLSRNPRGPGRVSFEFMAALCRALFG

SEQ ID NO: 791028 - protein, 118 aa, Homo sapiens
VFSVLISCGCSNKLPQTGWCKTIEINSLTVLEARSSKSVLLGQNQGDGRALFLLEGGCRRESIPCFSLILVGAGIPGYGPCPSSLRKQHFQFSLPCLLLLPLFWRQSLALLPRLDAAT

SEQ ID NO: 791029 - protein, 82 aa, Homo sapiens
TCKAHSRLRAQGVHPALATWAPLHGNHPNPRLPAGKQLFSTNPLQEQSRPGKALLAVRGRRDAPKAPFPDTTLKAGPSEKAT

SEQ ID NO: 791030 - protein, 108 aa, Homo sapiens
ILIFIFLYNTPPHHCVKNWPSPRQKWPASQCTKQTCLSSEPREDALLLMPGRIFRKILQNTVGVLILSFVFPISKGSQARLPQYFLLSYHKHSPRNDPNTSSWIQLTK

SEQ ID NO: 791031 - protein, 120 aa, Homo sapiens
MGSGAETVTVTVLFREEGRRNQCRGRLWGVDRRCPQLTGSMTLEEWKLRQSRDVRVNCSPGHRWRPEPSSLRAPGEAASAVCWCCPPAALGPHGTWLSPAPQGPFLLPPTCHQPPGQVSV

SEQ ID NO: 791032 - protein, 109 aa, Homo sapiens
CRHLELPTPWQQPACLCNARTPHSLTHPSHCSTSDSSLGGVGSRPVPRAKRSLPGRVGGTSLAGPSKTQSKAPPATGFQPEKRHPRDPHNSISINFREIEKATRMRIKL

SEQ ID NO: 791033 - protein, 71 aa, Homo sapiens
TPRWKEGLRMRSAWLPATFVYLELGRFHHGCKDGGKAERTGETGGVEVSSLESLQRCHLPKPGDQRRGFLF

SEQ ID NO: 791034 - protein, 39 aa, Homo sapiens
MELQAGPRGGIWNFLLSLTPTYNQNVYICFKKIKITLKM

SEQ ID NO: 791035 - protein, 103 aa, Homo sapiens
MKKLYLQSSKKAAITCCCRKLPCGLASWEFAWLFVAAIQNWEPQVKDAGKCHQSRREMQPRDASLTRRDCRVTLSDYQPRLEEIQPMMKFMAGKFPVQGGATA

SEQ ID NO: 791036 - protein, 123 aa, Homo sapiens
MQKPLWEERTPGQPLTPFPTPTSRLGARSCTWLCCGASLMSQSGGRQLCLWSLLLIVWKCRDVWFLPEQNRSLFLYYPELAKESHVAVGGVLGMRRGTAGRDYAEVELGLQVSATTPSSMQSQ

SEQ ID NO: 791037 - protein, 126 aa, Homo sapiens
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 791038 - protein, 327 aa, Homo sapiens
GRVGEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 791039 - protein, 164 aa, Homo sapiens
GGSRGSRPVSPPPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKPLVSPPSITVLEHVISPLTGLSGFKSLDKYHNRAT

SEQ ID NO: 791040 - protein, 108 aa, Homo sapiens
KKHMKKCSSSLAIREMQIKTTMRYHLTPVRMAIIKKSGNNRCWRGRGETGTLLHCWWDCKLVQPLWKSVWRFLRDLELEIPFDPSIPLLGIYVKILIQSNVLPYMVSL

SEQ ID NO: 791041 - protein, 163 aa, Homo sapiens
MNRLNPGRHVVFRTPTVAPRQPAPAAPRFQRPPQPRGLASTCPAGPQQKGSDPPGRSAGGGRWGRRLGGRGAPGFRVLPPPRGEQQDGAEAVSLSSAPICREGTPCSDLKVTAEPAGGLGRSRPTGPGGDPRADIGVQAAAPASAPTHAGPGPRSPGKSPAGG

SEQ ID NO: 791042 - protein, 116 aa, Homo sapiens
FGPRIHFHPTHIYQSAHLVPGTVLGANGHSGEQARHGFLESTFWCNVPLPFSLLISLISSSRAPLSSSHLYSNHPSPESHGTCRTSLALIVCIALLVLTILYVTFCVYVLPMQLDF

SEQ ID NO: 791043 - protein, 154 aa, Homo sapiens
ETAQAIKGMHIRKATKYLKDVTLQKQCVPFRRYNAGVGRCAQAKQRGWTQGRWPRKSTEFLLHMLKNAESNAELKGLDVDSLVIEHIQVNKAPKMRRWTYRAHGRINPYMSSPCRIEMILTEKEQIVPKPEEEVAQKKKISQKKLQKQKLMAWE

SEQ ID NO: 791044 - protein, 103 aa, Homo sapiens
EKSRSRQVLGPVFIGRTPCSGLPSTGPALGSVSPQAPSRCFREHQALSVSTSCKDLGFLLLQSPLGSSTPHCLMSRPLWWCPVLSFWSVLPAPPGSSSPKSDF

SEQ ID NO: 791045 - protein, 162 aa, Homo sapiens [sequence omitted]

SEQ ID NO: 791046 - protein, 108 aa, Homo sapiens
MPPPPDSMEARGSRKEFYQPLSPSTSSLLSVPPIDQTQLEPCQQRSHQLPLAQGRAENHSRECIWVGCEQNSRHIESSIARVFQSYRLKGSPGNCSTPRQVLQNFKTP

SEQ ID NO: 791047 - protein, 97 aa, Homo sapiens
HCEGKSPRRVQSFRLQFNEKYPQTTNTLPTRLGSPSSHRRTPARAGHFPGRRLQKEPVAGGLQAGCRDPPSEKRLRTRAATESQPGFYHPNPFWRIL

SEQ ID NO: 791048 - protein, 32 aa, Homo sapiens
GFLDSHTSASLRSSRFLLHGNNPLNYYSEKAH

SEQ ID NO: 791049 - protein, 186 aa, Homo sapiens
GVPWGMGRPGLRAVVSGPGEAVSLSQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 791050 - protein, 165 aa, Homo sapiens
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 791051 - protein, 168 aa, Homo sapiens
ECNQCGKAFSQKTSLKAHMRTHTGEKPYECNQCGKSFGTSSYLIVHKRIHTGEKLYECSECGKAFNTSSHLKVHKKIHTGENVYECSDCGKVFSGVSSLRMHIRTHTGEKPYECKECRKAFSVSSSLRRHVRIHTGEKPYECIQCGKAFSQSSSLIIHKRIHTERETL

SEQ ID NO: 791052 - protein, 172 aa, Homo sapiens
MGQGDGCLGSRQARGEKDAHAETWTAVTRPLADEAGSQHLVRGRQGTAQAATLPLSQALCMYGHMLIPVRQRLLKPYLSLDMWHWASYLIFLSTDFLTVEMAMRTQRMWRLRWTELRAAWATVGTELGARRPSGHISWPSAFPNGIPYPLPCSLPEVVLNDLRLFQNKGIHT

SEQ ID NO: 791053 - protein, 75 aa, Homo sapiens
TWNQPKCPSVEDWVKKYTMEYYLDIKKNEVMSLAATWLVPEAIMLSKITQKQKVEYHVLPYKWGLNNGHTRTYKE

SEQ ID NO: 791054 - protein, 143 aa, Homo sapiens
RKEIPYPVWNALLPLLSDRYSLPIPCSASSCGIFEKPSFIAILHLPCSWGSTQPLFHRTSHKTAAGMADLCICLSHQTVGSLNRVNMKNRSLQFLLIVYRWADLASMAEDTWGTGESTEGDVKSIGSSKEDGCTTICSSTCCP

SEQ ID NO: 791055 - protein, 109 aa, Homo sapiens
MLQTFSWPTLANRNLGGFFPRAMASVLRCPCRGWLCACLPSDHCRGWLCACLPSAHYSWLSGAPQRICQIGHDIEGLRALWVFISLIPASYPNAVFKSPWSSLPALQCC

SEQ ID NO: 791056 - protein, 188 aa, Homo sapiens
MPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEV

SEQ ID NO: 791057 - protein, 129 aa, Homo sapiens
EGCVYEARPGAVSAPRTGFTQEVMVIVLCKRPLWRRRVAVLWWRRWVHGCSGHSMGPSKGLEPSWGLEQGQGLLDKPCLLSWARSPTQCPGAPFTCWCPQGHPAPESQVTVSAGHAGVRWHLTASGTHR

SEQ ID NO: 791058 - protein, 84 aa, Homo sapiens
QSHEGTASQSWVKLTLPGKWRAGIPVSQPPSGRQQPGRGTHSVIPSWLEGSGLVDPASSLMEKVAPDADPYRPGPQALAGSACF

SEQ ID NO: 791059 - protein, 102 aa, Homo sapiens
MRTCMQYKSRDAGTESCASPLLRAESGYPPFQLFLLPRSRGPLPEGRTAQLRRGAKERNPRLRGARRCSSVPGPCSAVPTPTVPSSGRAGTRRCEGSCPAPP

SEQ ID NO: 791060 - protein, 219 aa, Homo sapiens
GKFFMDSSTLIKHQRVHTGERPYKCNDCGKFFRYISTLIRHQRIHTGERPYECSVCGELFRYNSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTMEKVYH

SEQ ID NO: 791061 - protein, 219 aa, Homo sapiens; identical to SEQ ID NO: 791060

SEQ ID NO: 791062 - protein, 219 aa, Homo sapiens; identical to SEQ ID NO: 791060

SEQ ID NO: 791063 - protein, 102 aa, Homo sapiens
GEPVGRHPCSQAALTSRRGPPTAPGWKSAQVLSLVETQQVLGEAPKVGPRLGAGWFLESQGVWARCRDGPSRALGSGCPCPAPSHNKDGFLPPLQGLLASWG

SEQ ID NO: 791064 - protein, 89 aa, Homo sapiens
MSLKETWPRGAVWCCGIGLLCGVDPLVVQEGRALTEGAATLRAHEGLLARVNAPVAEQHGALGETLATVHAAEGPLARVQELVLGEVGA

SEQ ID NO: 791065 - protein, 134 aa, Homo sapiens
HGIMFFCNNCKVFRFCKSKCHKNFKKKCNPHKVRWTKAFQKATSKELTVDNSFEFEKHRNELIKYQQELWNKTIDAMKRVEEIKQKWQAKFIMNGLKKNKELQKVQDIKEVKQNIHLILAPFAGKEKQLEEKMV

SEQ ID NO: 791066 - protein, 112 aa, Homo sapiens
DPSISTSQSAVIAGVSHHAWPRHPLSKGHLKAQRGPSAQTLLSQQTLLRSQSLWGHHQQGRSARATLSLVRGERREWAPTDHIALRQGKPMVCSGIRVDRLQIPLRREASVI

SEQ ID NO: 791067 - protein, 31 aa, Homo sapiens
MCKQAQKKTAPSSVCDKAERGARSHHLKLQE

SEQ ID NO: 791068 - protein, 124 aa, Homo sapiens
SHFAWEGRRKGNLHRLCPRRVLILLANSKRTPTHWKVSQEPTLDAEESWGVPLSGTPVSFQKVRDPPRRGLQRSALRPPNLKLISRSSRGSDRLCKWSGPVHRLLGRHLWTATDSTSLCHPLGG

SEQ ID NO: 791069 - protein, 113 aa, Homo sapiens
SHFAWEGRRKGNLHRLCPRRVLILLANSKRTPTHWKVSQEPTLDAEESWGVPLSGTPVSFQKVRDPPRRGLQRSALRPPNLKLISRSSRGSDRLCKWSLMGSRGKELLSAEKH

SEQ ID NO: 791070 - protein, 116 aa, Homo sapiens
MLSPVPAFGLQAPGFEWVSSRPHRACICDSRGPYQVAASKAFLPALQPPLISANATSAPWVQSQSSLSLGSAFLHLCLDLLFGNCFFASFAGFRLGESFFFLRRSFAFVAQAPLNG

SEQ ID NO: 791071 - protein, 124 aa, Homo sapiens
VEELSFAAACCVPSQEPAPAFNELNGWEYGESYKGELWDAVRTYTWGFFVLHERHRKGRSSRSQEASLGELQGQLGRAGAQTAAPAQTPGMGKAVVRAEVGRRLPALDLDCSHSNGRFAPMSPF

SEQ ID NO: 791072 - protein, 120 aa, Homo sapiens
PSGLGPSTSGLSEQICTVSKWRRKSRSSILHGGPVRPCPAPPRGGPKIPEMTPRSQSPSHFLNIVKYPSGSRNEPQMPGPLALPNSSKSSDMPHKSPRFTSCPQISLNCHQPPNSKTLRL

SEQ ID NO: 791073 - protein, 102 aa, Homo sapiens
MANTQLDHLHYTTEFTRNDLLIICKKFNLMLMDEDIISLLAIFIKMCLWLWKQFLKRGSKCSETSELLEKVKLQLAFTAYKYVDICFPEQMAYSRYIRWYIH

SEQ ID NO: 791074 - protein, 62 aa, Homo sapiens
TRADLGTRHQVIKALEEPGWRAPQTPPVQLTVTVQDPCPEPLGLLESGWRENLELPILSNPL

SEQ ID NO: 791075 - protein, 306 aa, Homo sapiens
EFTGMPEQWARLLQTSHITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSK

SEQ ID NO: 791076 - protein, 112 aa, Homo sapiens
ATPRPCRAPCPRHPTPTPACHPYCDIIVISNPLSPQVAGVALPSLCAFLPASSGSRAGDQGPVRESVGLWNLIAFGLTKPLSLNADSICSSKPSADDRGGRAIAVLDYTDCS

SEQ ID NO: 791077 - protein, 309 aa, Homo sapiens
RAGKVTNYSIQVLAFTRAVRRGQEEQIFTRTKEDVPGPPAGVKAAAASASMVFGPGIPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRI

SEQ ID NO: 791078 - protein, 228 aa, Homo sapiens
HFPVPAPNQEAPSLCPKITPHLEVTRGLAGGSCQGTGSGEWRKHWVPGFGLGAMYASSYPPPPQLSPRSHLCPPPPHPTPPQLNNLLLLEGRKSSLPSVAPTGSASAAEDSDLLTQPWYSGNCDRYAVESALLHLQKDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 791079 - protein, 104 aa, Homo sapiens
KQEGRYLEKCQKSPCQSPTVASGNCSQHEAHGTHGCPASLASSSPPWRPWSSTSCGTLCPLWTDTAAAGNSPACSSPPSLEATAKYTPPLAPVCFLSRPTLGCL

SEQ ID NO: 791080 - protein, 174 aa, Homo sapiens
GRADKAADAVFFFTFALMVFTARRVYESEDPRATLVGDGQDTTARQAAPASGGGNARRSRRASAVETGSQVLAEWTSPYISGPAPVRQAAGDWPGGGSHSNCLLCLANQGSPGSQRRCVCGVRHLCLSSVFLGLAPADPSWARTVPLGHLPQATKPPRWASLGPVSRRTEMTNR

SEQ ID NO: 791081 - protein, 174 aa, Homo sapiens; identical to SEQ ID NO: 791080

SEQ ID NO: 791082 - protein, 174 aa, Homo sapiens; identical to SEQ ID NO: 791080

SEQ ID NO: 791083 - protein, 78 aa, Homo sapiens
EWPRSFFAIFCALSWEVGLAPTGTRGTSLVTRPVEVGAVMTAAKGGTSVLKLDKGSHQTHWHIPESPSVGAVCPGHNI

SEQ ID NO: 791084 - protein, 102 aa, Homo sapiens
SSGAVGLTSAHQLSTQMGEEEMALQRPSELPPAAHSRASVMKIHQLSPQLGAWELRAGPDNLAPAPRAGTFPSFSSELHQRKQRPVTPLLFLPRLRPPPLTL

SEQ ID NO: 791085 - protein, 144 aa, Homo sapiens
MLPKAPEASQKAPVPPPTPHSSLTSSWPLTFLGIENAGLTQLAEEGAPTAGGLQVVQVEVGWVQPTGQVGEAFMGVAAHSCTMGRLLGVGERKDRSEGSGTGLPWDEAEGPIPLATKLPKKASPWKGSLEGQKSFQCCLEEQLQ

SEQ ID NO: 791086 - protein, 239 aa, Homo sapiens
MQTGRTESQRCESRPTASKPPALKNPPKFAPLPENSVNFCFDSAFLTVRRVPAEVSNTHQNSYQPGRKHGEQESSKNPEMACHGSSSFLPAANDTATLCESKFPSPHHKPVTGEPGRGKGTFLHSENSAFESWNAHQPKLLERKDTAGTVPESKAPKHYGDTTLLREPCPPERTVSPCQVQASCSQEENRLAAGALSTSIPWGCRDPGAQVFAVEGKAPSSQPDSQEKPAQPPWRKPKT

SEQ ID NO: 791087 - protein, 179 aa, Homo sapiens
KGDREVLGGEGWVPGEGSTPGPVPTDLGEDRHSSLHVQMLHFPRPLCPATPPFCAYKNPKTLAGRHTSWMPRETHWRRNTQVDGRREECTGVGAHWDASRPSTGGMTQSLAGAVGEELGHQAARLQGKTISLLAAPSAESCFHSIKPRTHSPSPHVILFFWYAKARIQKALCPCHKAGV

SEQ ID NO: 791088 - protein, 68 aa, Homo sapiens [sequence omitted]

SEQ ID NO: 791089 - protein, 103 aa, Homo sapiens
EESRLWGRVAEKQVQGHIASQRHLYCNSGLCFAYCSNFPFAQMKTFRHGGQFFRKILLLGKDKTEPAPDSGTSCHDHFLKIQTYFLPTLLDFIPSIPINIRKV

SEQ ID NO: 791090 - protein, 105 aa, Homo sapiens
VPVCCKPVCCVPVCCGASSCCQQSSCQPACCASSSCQQSCRVPVCCKAVCCVPTCSESSSSCCQQSSCQPACCTSSPCQQSCCVSVCCKPVCCKSICCVPVCSGA

SEQ ID NO: 791091 - protein, 99 aa, Homo sapiens
GKWLTDEGRASSGCLNPNRCKFTPREAGMKARDRKRGGGGGGGGGAQRRPLPPGPPRRLCQLSSEQVSDTDFPGVDSQPLPLGPRASPTRTRILETFNL

SEQ ID NO: 791092 - protein, 77 aa, Homo sapiens
LVAYIYSQVKMKNKLTGRLHGDGSVEARLGVRWPRLGRSSLCVTCLGCVVRRLGVVRLLTCAPAESVAVPAGMLGAQ

SEQ ID NO: 791093 - protein, 142 aa, Homo sapiens
GCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQQYQKKWM

SEQ ID NO: 791094 - protein, 144 aa, Homo sapiens
GCQRSIGLSNGKAKVCNYSGWYYCSSCHVDDSFLIPARIVHNWDTSKYKVSKQAKEFLEYVYEEPLIDIQQENAMLYHHAEPLAAVLRLRQRLKSLRAYLFSCRAAVAEDLRRRIFPREYLLQQIHLYSLADLQQTQALQPNLT

SEQ ID NO: 791095 - protein, 622 aa, Homo sapiens
DPDLPTCTTLAMGNSHCVPQAPRRLRASFSRKPSLKGNREDSARMSAGLPGPEAARSGDAAANKLFHYIPGTDILDLENQRENLEQPFLSVFKKGRRRVPVRNLGKVVHYAKVQLRFQHSQDVSDCYLELFPAHLYFQAHGSEGLTFQGLLPLTELSVCPLEGSREHAFQITGPLPAPLLVLCPSRAELDRWLYHLEKQTALLGGPRRCHSAPPQRRLTRLRTASGHEPGGSAVCASRVKLQHLPAQEQWDRLLVLYPTSLAIFSEELDGLCFKGELPLRAVHINLEEKEKQIRSFLIEGPLINTIRVVCASYEDYGHWLLCLRAVTHREGAPPLPGAESFPGSQVMGSGRGSLSSGGQTSWDSGCLAPPSTRTSHSLPESSVPSTVGCSSQHTPDQANSDRASIGRRRTELRRSGSSRSPGSKARAEGRGPVTPLHLDLTQLHRLSLESSPDAPDHTSETSHSPLYADPYTPPATSHRRVTDVRGLEEFLSAMQSAPGPTPSSPLPSVPVSVPASDPRSCSSGPAGPYLLSKKGALQSRAAQRHRGSAKDGGPQPPDAPQLVSSAREGSPEPWLPLTDGRSPRRSRDPGYDHLWDETLSSSHQKCPQLGGPEASGGLVQWI

SEQ ID NO: 791096 - protein, 158 aa, Homo sapiens
MGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 791097 - protein, 64 aa, Homo sapiens
MVNSRFFGVCSRRTTGVGVCCENGECRGTPLTEKRALGNDCERVNELMTKIRCGGPTAQMVMPF

SEQ ID NO: 791098 - protein, 486 aa, Homo sapiens
MVNSRFFGVCSRRTTGVGVCCENGECRGTPLTEKRALGNDCERVNELMTKIRCGGPTAQMIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 791099 - protein, 384 aa, Homo sapiens
MTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 791100 - protein, 384 aa, Homo sapiens; identical to SEQ ID NO: 791099

SEQ ID NO: 791101 - protein, 268 aa, Homo sapiens
MPCSSKRNFCRQTMPSFIHEDDKNGRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 791102 - protein, 328 aa, Homo sapiens
MVNSRFFGVCSRRTTGVGVCCENGECRGTPLTEKRALGNDCERVNELMTKIRCGGPTAQMIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQVLERPRSVPS

SEQ ID NO: 791103 - protein, 501 aa, Homo sapiens
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 791104 - protein, 501 aa, Homo sapiens; identical to SEQ ID NO: 791103

SEQ ID NO: 791105 - protein, 494 aa, Homo sapiens
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSGFLALMPAQACDM

SEQ ID NO: 791106 - protein, 192 aa, Homo sapiens
SDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGRFRITKPSSQ

SEQ ID NO: 791107 - protein, 108 aa, Homo sapiens
THIQSGKKSLDSSIVFILKKKKDSGVRLLTLYSHLKTFRQKSSNSSSRVSGFLSIDAASPQRPQVPQAPSPPPAQNKGRHPQTSGHRSPTRTHTHPSLSPPSESPSNA

SEQ ID NO: 791108 - protein, 38 aa, Homo sapiens
MVQPFVDDPDISGHHLPMSALFSSGFPVLVWCLSDGRP

SEQ ID NO: 791109 - protein, 122 aa, Homo sapiens
MFSLRSHCRLCGHLQTLRSVWTTFVSTTLSGFCSGWLSIVPTHLRTTLSTIGNSSSPAIGPQRSPCLHTSSVSNLHTQLSPGLSFRDLASHPLALQRSPGPFQLSLAPHAARTPWQAVSGIY

SEQ ID NO: 791110 - protein, 120 aa, Homo sapiens
MLLIHTCGPQETKGDLCWHGLDFLSTNAHEMWKLSEHPHQNHTLKQAGWGRETPSHHGEAEMLQPPRSLCSRGGTILLCVLPALSEVCEGRGQCSKELALPQRREWNVRGHMKAVTLPTF

SEQ ID NO: 791111 - protein, 74 aa, Homo sapiens
AELELEEDEEEGEEAELDGDLLEEEELEEAEEEDRSSLLLLSPPAATASQTQQIPGGSLGSVLLPAARFDAREA

SEQ ID NO: 791112 - protein, 132 aa, Homo sapiens
WANRCSVFQALSQVSADLAAPRNGPSGPAAARTLLHSKLLRAPGAPRSLGEVRAGVRRAKGTGEPCRSRLSPARLLRDRIKGSHSVRRGRECCLSSFASELRERVVFCFSAPHPPELPAPERGRRLQVAGNR

SEQ ID NO: 791113 - protein, 75 aa, Homo sapiens
PPHLAFRVFQVGPERPVLKGSGPPETLPGVRIWASAPGCRAQAVPGLYELWGCSPFFPGFLPGPGWFQQNSRQGT

SEQ ID NO: 791114 - protein, 104 aa, Homo sapiens
MSWGCHSSWAEPAGSGQLSWPKHQCMNHPRGIPGAHSQEPKSGGCSWDPSPVNCPCQAFLASLYLPVQWAQPPCWDRRVCPTSRSILTASDSCQLTTNGFPPPQ

SEQ ID NO: 791115 - protein, 104 aa, Homo sapiens
MDASLLKCHSRKVVWGPYSVIDHEGWPKKGLATQEVVENVQLISLQAYADYSRGTPHGSWANGKCCDEKRCTEPAPRRRRHTMAHMYENEGRYVKQSQTGKEKE

SEQ ID NO: 791116 - protein, 75 aa, Homo sapiens
RTPSVGGPPEDQLNLELRRKMCCEQGEPQLPQAVQDRRVFLKAGASFEEVPIRLHLVDYSGAATKRDEQACVEIE

SEQ ID NO: 791117 - protein, 75 aa, Homo sapiens; identical to SEQ ID NO: 791116

SEQ ID NO: 791118 - protein, 78 aa, Homo sapiens
AVEGGASCGARIQLPRFPQLPRTLSVSRGSSVNQHAASPGTLGMGSLCGSGEASTGFAALSEKAGCLSVLLVGGSPPL

SEQ ID NO: 791119 - protein, 88 aa, Homo sapiens
AQVLPWQQVISLQEDQGLAGLQGSQGHRREALAVWLQLGSCLLGTHSFFLRCLQASSLALGNGDSGSTPAPCNQELLAWWESRGDMKR

SEQ ID NO: 791120 - protein, 82 aa, Homo sapiens
HEQRKGRLLRPPLFVFEGAMRGDRGRGRGGRFGSRGGPGGGFRPFVPHIPFDFYLCEMAFPLKPETRVGCLLCFYSALHWKF

SEQ ID NO: 791121 - protein, 101 aa, Homo sapiens
PVVPPAGHRALSPAGVLLAVPAMLSLDFLDDVRRMNKRQVSLSVLFFSWLFLSLRGCCCGARRTPGFWCEGLSWSDTRVIRFLWRLWPEAALSASLFLTPN

SEQ ID NO: 791122 - protein, 70 aa, Homo sapiens
MLSLDFLDDVRRMNKRQLYYQVLNFGMICLIWHYTDLGKGLIGNNLEVKVLIVCVCSDGSYWNLAYSYEE

SEQ ID NO: 791123 - protein, 86 aa, Homo sapiens
CSTGEPGPGRDHPSGHRGHPGAAGAADKGVCLIHALQTLVSLLQPRLVCNGVFLAHCNLHLLGSSDSPASAFRVAGISQMPATTPS

SEQ ID NO: 791124 - protein, 127 aa, Homo sapiens
QRTHTGEKPYRCSECWKTFSQSSTLVIHQRTHTGEKPYKCPDCGESFSQSFNLIRHRRTHIGEKPYKCTSCEKCFSRSAYLSQHRKIHVEKPFESPDVGDFPHEWTWKNCSGEMPFISSFSVSNSSS

SEQ ID NO: 791125 - protein, 103 aa, Homo sapiens
TTKMRGNRNREAENSKNQNTSSPPKDYNSLPAREQNWMENEFDELIEVGFRKWVITNFSELKEHVPTHHKEAKNLEKRLEEWLTRITSVEKSINDLMELKNTA

SEQ ID NO: 791126 - protein, 115 aa, Homo sapiens
ALWERGLCLGKQPACRGWKRKRPKTPEKNGAWPPARREMARFQRTKEREEDRCSLNIYYVRNTTQGTAPACVGKRMQPSPTGKGGKCCTVHGLTRKIHNVQPNLQSPILSAACVD

SEQ ID NO: 791127 - protein, 106 aa, Homo sapiens
VPLVEFGCESVWFWTFFGWNGAWPPARREMARFQRTKEREEDRCSLNIYYVRNTTQGTAPACVGKRMQPSPTGKGGKCCTVHGLTRKIHNVQPNLQSPILSAACVD

SEQ ID NO: 791128 - protein, 108 aa, Homo sapiens
MELNTNIKSKKGLGRRNLKPMNGAWPPARREMARFQRTKEREEDRCSLNIYYVRNTTQGTAPACVGKRMQPSPTGKGGKCCTVHGLTRKIHNVQPNLQSPILSAACVD

SEQ ID NO: 791129 - protein, 108 aa, Homo sapiens; identical to SEQ ID NO: 791128

SEQ ID NO: 791130 - protein, 101 aa, Homo sapiens
ALWERGLCLGKQPACRGWKRKRPKTPEKNGAWPPARREMARFQRTKEREEDRCSLNIYYVRNTTQGTAPACSQGRYIMYSRIYSLLFCQLLVLIKTSIKIL

SEQ ID NO: 791131 - protein, 258 aa, Homo sapiens
MPVILSPQRTGSGATGGPAARAYSVAEAVKQFRAGPAGTGAGCSLQGCWAAPRPFEHRTNKLRELSTLAHCSRELQTQVPDASAHSLAVTLSELHSCRDLQDECLDSRFAEGPRRLLPPYHSLINNFVKPEKLTKVETRLKEKIVAEMTDLNKHIKQAQTQRKQLLEESRELHREKLLVQAENRFFLEYLTNKTEEYTEATGEGFGTGILQTSGQIGRGKTRISSRFGEQISVRKTRALRKGNFIRFEGICCMWGHCL

SEQ ID NO: 791132 - protein, 111 aa, Homo sapiens
MTDLNKHIKQAQTQRKQLLEESRELHREKLLVQAENRFFLEYLTNKTEEYTEHLEKVLEQLFYNQVDRLDEERQELAPDLENKFQCVKHGLCEREISSDLKEFAACGDIVY

SEQ ID NO: 791133 - protein, 98 aa, Homo sapiens
PAGHGKEGRGGVFIQECASELLLFPFFSPAPPSCCLSVAVCVCVSFSRSCDADLGGGWAGAGGHVAGSLQPRRVCALLGLFNSKICTNLQSISASAQE

SEQ ID NO: 791134 - protein, 75 aa, Homo sapiens
STILHRANFRAAVRGCRCSLTGQVGLSAVTKSGCPPLVKPLGGCGGAEGSVQEPLSPSQGSLSSWIVCARVHVCA

SEQ ID NO: 791135 - protein, 73 aa, Homo sapiens
NESEHGLWGFEGSGSSLILTSFFSCLLRSSHSSAFHALGLLCMLLSLPGVVPWYPSPVYFLVLSVKAPSPYLR

SEQ ID NO: 791136 - protein, 128 aa, Homo sapiens
RKKFMKCIIFFFLKMELKKNFFNSNLPFTPSAELSSPKSKHTPVPTSRMESPPSYARVFMIWPQPTILAPGHGPIFHILCCLHRKQLANPRHTCFHLERLPIMIPPPGPFTWKTPIHSSKPSSDGTSP

SEQ ID NO: 791137 - protein, 149 aa, Homo sapiens
RRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGEPEA

SEQ ID NO: 791138 - protein, 238 aa, Homo sapiens
RRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 791139 - protein, 122 aa, Homo sapiens
SVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTGVLCMYSLIRVRLI

SEQ ID NO: 791140 - protein, 145 aa, Homo sapiens
RAPVPRSLLGSRRRERTEETAAAAQSPGPRDEAPTCPQLPGPAGELIIHPTGSGFAGPRDAALGGRAPALSARPLRAPGKEFVWLSLRLSAEVAGLRGDPRLGESLGRTKRRTVWRRSHPWPSRLPLPIPSLPLRGGKGRTWKKK

SEQ ID NO: 791141 - protein, 103 aa, Homo sapiens
SLSCISWSFHYSSQRENIYHSADGCICTFKTFLRGYSAPGRLLLWLMTMRMIIPRVWSMPLSQGPHEPNQLKSFRSNNEPDGESTCFSQAACLFGLSMCNKKH

SEQ ID NO: 791142 - protein, 106 aa, Homo sapiens
RVHILPDTGTVCGLVSKAMAQTHSLVYRVGNLGLTRFSVFHKRDRTGSLASELKIQISVVTQVSRKARFAWLCCDVQLSITVCLGAYRMLVSAFPLSGRMLPSQVA

SEQ ID NO: 791143 - protein, 164 aa, Homo sapiens
GTSKILPGLCIGNFKDARDAEQLSKNKVTHILSVHDSARPMLETRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGIMKFWAFLRRL

SEQ ID NO: 791144 - protein, 185 aa, Homo sapiens
GTSKILPGLCIGNFKDARDAEQLSKNKVTHILSVHDSARPMLETRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 791145 - protein, 112 aa, Homo sapiens
AVAGLAAGGDCGGGSLRRGWGLLRGTSGPGGMEVPLRGGRKKRGKVAQEGACPPGFPGATVARVPGGHAPGQQGVVPAGSQAGAGCLLGRSDLSAAVCKQYARILFIVKNFY

SEQ ID NO: 791146 - protein, 105 aa, Homo sapiens
LDHRWTLYHADYFFQELGLRPRDSWHPLLAARLIFLYLGNRRGAADAYLVEQRKAGSSQRKRTRQSDRGEQAWELRGANVHLCPSFPLDAPESLPSTPACLLKLV

SEQ ID NO: 791147 - protein, 126 aa, Homo sapiens [sequence omitted]

SEQ ID NO: 791148 - protein, 70 aa, Homo sapiens
MGPGAEQWETIQGVVTTTKLPSVWAETELYPSPTPILPAIPPDSRPKGIKDESEGRREGPQENRTQASTV

SEQ ID NO: 791149 - protein, 121 aa, Homo sapiens
MTLHSTSFHYWVMRKKFDSRWVPLSVWNLHILLKSVWVFSGYYSFLPHPKHTHRMLGLSACLNGPTFEQVRCVCVCVCVCVCVCVCVSAPCDGMASWPGLVPPLCPELLGWALATHKPELE

SEQ ID NO: 791150 - protein, 107 aa, Homo sapiens
FKTAWLSESHRSRDWMPGLVPVGQHRLRRRGLWRPQAEPLRGIFKQRAPHTSWDPRVWLPCRVWELQRVGNQGAVAHACNPSTLGGQGSRGQEIETILAHTVKPHLH

SEQ ID NO: 791151 - protein, 118 aa, Homo sapiens
GACTPRDGETETRARDTHADRPEGCREGEGEKSVEAGSGGKRPGAGRAQQSGRGAGSWLVKAASSGEITARIAELHKTPPARPAAEPAPISSLIAARAGYAFKCYLIGLRRSWGPERP

SEQ ID NO: 791152 - protein, 90 aa, Homo sapiens
MELLRLQVESEASSMPGMVRALRDRDPLLQEPKAHAVLLTTELYYTFKEEPLPILLKLFQKTKEEGTLPNSLYKATITLIPKPDKNTTTK

SEQ ID NO: 791153 - protein, 77 aa, Homo sapiens
QDAFFNLDFQPRSGNKLRVCSISFEAVECRRQHDTGLLYKVKTSCLSEIRLPVNFFGLESNLRILHLAPFNFLGISP

SEQ ID NO: 791154 - protein, 118 aa, Homo sapiens
MSCQQSQQQCQPPPKCTPKCPPKCTPKCPPKCPPKCPPQCSAPCPPPVSSCCGSSSGGCCSSEGGGCCLSHHRPRQSLRRRPQSSSCCGSGSGQQSGGSSCCHSSGGSGCCHSSGGCC

SEQ ID NO: 791155 - protein, 1388 aa, Homo sapiens
MSIPLHSLRFNNTMREENVEPQNKQMAFCRPMTETRADVQILHSHVQLPIVSTSASDPGGTSTQLMTSPVFDTMSAPLMGVPNSGALSPPLMPASDSGALSPLLMPASDSGALSPLLMPALDSGTLSPLLSTSEYGVMSPGMMTIPDFGTMSATLMVAPDSAEISPLAMPAPSSGVVCTPIMSTSSSEAMSTPLMLAPDSGELSPILMQDMNPGVMSTQPVPAPSSEAMSPLQITDEDTEAMSKVLMTALASGEISSLLMSGTDSEAISSLIMSAVASGGTSPQPTSTQNSGGIPTPLMSDLDSGIMSSLLMSSPGSEVMSTPLLSVPDAGEMSTLPKPAPDAEAMSPALMTALPSGVMPTQTMPAPGSGAMSPWSTQNVDSEMMSNPPVRATASGVMSAPPVRALDSGAMSTPLMGAPASGNMSTLQKTVPASGAMTTSLMTVPSSGVMSTEQMSATASRVMSAQLTMAKTSGAMPTGSMKAVAKQYKRATASGKMSTPLRRAPTSGAMSTQPVTATASETMSMPQLTVPASGSMSMLQMRAPVSEAMSMPQMRTMASGLTSAAQMKAMTSGAMSTPLMTAQTSGSTSTLLMRDTASGVMSCPQMRSLASGALSKPLMTPKASGTMFTEKMTTTASEAMPTLLMRDTVSGALSMPQMTDTASGGLSASLMRDTASGAMSTSQMTATVSGGMSMPLMRAQDPGVMPASLMRAKVSGKMLSQPMSTQDPGGMSMSPMKSMTAGGMQMNSPTSDVMSTPTVRAWTSETMSTPLMRTSDPGERPSLLTRASSSGEMSLPLMRAPASGEIATPLRSPAYGAMSAPQMTATASGMMSSMPQVKAPISGAMSMPLTRSTASGGMSMPLMRAPDSRVTSTSQMMPTASGDMCTLPVRAPASGGVSSPLVRAPASGTMSTPLRRPSACETVSTELMRASASGHMSTAQTTAMVSGGMSKPLMRAPASGTMPMPLMSAMASGEMSMPLMETMASGATSTLQTSVANSRSMSLSQTTYTVSGRMATAPIRASASGARSTSFMRASVSGSMPMPLPRATASGCGMGMSMPQMTATDSRGMSTPLMRASGPGTMSTPQTAFGVMSTPEIKATDSGEASTSHINITASGSKPTSHMTATTPETAKPPPKEVPSFGMLTPALCYLLEEQEAARGSCSVEEEMEIDEEKQMKGFLDDSERMAFLVSLHLGAAERWFILQMEVGEPLSHENKSFLRRSQGIYDSLSEIDILSAVLCHPKQGQKSVRQYATDFLLLARHLSWSDAILRTRFLEGLSEAVTTKMGRIFLKVAGSLKELIDRSLYTECQLAEEKDSPGNSSQVLPTACKRNNEEAMGNELSSQQQTEEHQHVSKRCYYLKEHGDPQEGLHDHLGQSTGHHQKAHTNK

SEQ ID NO: 791156 - protein, 113 aa, Homo sapiens
GSRVYDLEGFCPLGGDPGSSTWWRVQREGEPPKDLPQTLLCRWVAFTRFWIFPACAFLSSSTRNLLPGQKGVRGVIAVDPPSSSSQTHLCLLCIHQGQLCLQVSLSAPVTPGG

SEQ ID NO: 791157 - protein, 156 aa, Homo sapiens
KPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGCQDIADEFRAQEIDGQALLLLKEDHLMSAMNIKLGPALKICARINSLKES

SEQ ID NO: 791158 - protein, 107 aa, Homo sapiens
KPDNQSLGHRGRRPSGPDGAAREHILRQLPITYPSAEEDLASHEDSVPSAMTTRLRRQSERERERELRDVRIRKMPENSDLLPVAQTEPSIWTVDDVWAFIHSLPGM

SEQ ID NO: 791159 - protein, 104 aa, Homo sapiens
AGRGQRVGRWAPVKFATMYSVTRCRNAGSGDSIYGIQKEPVTIPAPTSNEHANVTGVVFSRCDEKELEAGQAEAHLSGSPPGCQSPLVVSRCCLHRFTQTPPVG

SEQ ID NO: 791160 - protein, 112 aa, Homo sapiens
TLTPPAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGM

SEQ ID NO: 791161 - protein, 56 aa, Homo sapiens
MVEADRPGNLFIGGLNTETNEKALEAVFGKYGRIVEVLLMKDRETNKSRGFAFVTF

SEQ ID NO: 791162 - protein, 72 aa, Homo sapiens
VPAHPHLRLENSWPVEYPVCRRASLQVTGKGCRVAYPAGEAARRGPGAATGLREDRPRVADFDLQGQSLTAA

SEQ ID NO: 791163 - protein, 79 aa, Homo sapiens
MDPSPAVRPDGSPLLACSDPYARLGWLSGGSWGDLATWDRRACAAPSSEVPNVGHTLAQRGPSGQWRRAIGGARALGQG

SEQ ID NO: 791164 - protein, 36 aa, Homo sapiens
MIPLYPSFNFNKSHFAFQILPIATNILFFSGVAELI

SEQ ID NO: 791165 - protein, 131 aa, Homo sapiens
SQVWSDQGCISGHLQGLATAHSQARQLLCRAGSSRHRDRGQLCASLQLDHMHQQVPLQGLLSGQGEYGGTWQLRDARNCEAPKRVSQPWLREPLGVGSPKDHSSSLLLVTCNVASFGCGHFSPVYVTSSFS

SEQ ID NO: 791166 - protein, 76 aa, Homo sapiens
GIPEGGSDPTKVKGLPPGNQPLLIPKAACPPWRARDPQILSTKGAGPVSDAGLRPGLQGVALARDGTAHPSRHHPG

SEQ ID NO: 791167 - protein, 84 aa, Homo sapiens
LGAFRLRLHQVHFVVWEFLFHAPRWEAGSSRKEQKGLGLWSCQRSPGALLGSPQTHVQQWEVSFCPFFCLPFPCHLLHPHRWKG

SEQ ID NO: 791168 - protein, 91 aa, Homo sapiens
LTQGPMAVSGKPGLLTAPASSMHASPSAEPGQAQGNATTEPERQPGGGGLDREMWKKQLIPEISCLAWIRPCWGLAAPCPVGAGAFRLGVF

SEQ ID NO: 791169 - protein, 90 aa, Homo sapiens
LRSPHSYPRAKDKSPFTDPSSNCPDSYRMRSTYLFTSHNKAGKKTSPGCGQVTCTPDSLSSPTLTQFSCTPNSAPQPRPGSGPIKACYFL

SEQ ID NO: 791170 - protein, 67 aa, Homo sapiens
RGPGPAPQKGKVGMKKAMTWDNHRQWQVSGLPTQHGDPQAYQDIKVHPGGHIRLRRLLPVSLQLMSG

SEQ ID NO: 791171 - protein, 103 aa, Homo sapiens
MPVFEPKIMLLPGTPYFRVGISKADLRMAPGQPEPSPSTSTPTLQTPDVFTSICPGRQPWSEPLGESQGSTLRKGPIWLPLPSLAQLERQEGGVASLLARPHV

SEQ ID NO: 791172 - protein, 334 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTDLFQTLTLNLCYSA

SEQ ID NO: 791173 - protein, 334 aa, Homo sapiens; identical to SEQ ID NO: 791172

SEQ ID NO: 791174 - protein, 110 aa, Homo sapiens
MPRETHWRRNTQVDGRREECTGVGAHWDASRPSTGGMTQSLAGAVGEELGHQAARLQGKTISLLAAPSAESCFHSIKPRTHSPSPHVILFFWYAKARIQKALCPCHKAGV

SEQ ID NO: 791175 - protein, 157 aa, Homo sapiens
WLGCHTQSCHTHSGVELAHCPATHGCSSRLQCSHAVSTVCTPVSLCKDVGLSLQEQFSDHRQSENHGLRHHLWGSREGPDLADRCCVGRAGPCSLGSVTFHSVSSPSLAETDGERDRDGEREMERDRDRRREMEREIETERERERQRDRDRERETER

SEQ ID NO: 791176 - protein, 470 aa, Homo sapiens
QAETRRTEVFRIDEEPPNMASESGKLWGGRFVGAVDPIMEKFNASIAYDRHLWEVVLFKASNSNKEGAVEKAGLLTKAEMDQIIHGLEKVAEEWAQGTFKLNSNDEDIHTANERRLKELIGATVMGSCTRDGAWNDQVVTDLRLWMRQTCLQRSRGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKCAGLLMTLKGLPSTYNKDLQEDKEAVFEVSDTMSAVLQVATGVISTLQIHQENMGQALSPDMLATDLAYYLVRKGHPMPFRQAHEASGKAVFMAETKGVALNQLSLQELQTISPLFSGDVICVWDYGHSVEQYGALGGTARSSVDWQIRQVRALLQAQQA

SEQ ID NO: 791177 - protein, 385 aa, Homo sapiens
QAETRRTEVFRIDEEPPNMASESGKLWGGRFVGAVDPIMEKFNASIAYDRHLWEVVLFKASNSNKEGAVEKAGLLTKAEMDQIIHGLEKVAEEWAQGTFKLNSNDEDIHTANERRLKELIGATVMGSCTRDGAWNDQVVTDLRLWMRQTCLQRSRGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTQMPFRQAHEASGKAVFMAETKGVALNQLSLQELQTISPLFSGDVICVWDYGHSVEQYGALGGTARSSVDWQIRQVRALLQAQQA

SEQ ID NO: 791178 - protein, 73 aa, Homo sapiens
ADGGWPGGQDPGSSPCASLFPQCAGLLMTLKGLPSTYNKDLQVEAGGGLASMCQFSGLWHTQAGPHPGIAIHP

SEQ ID NO: 791179 - protein, 423 aa, Homo sapiens
QAETRRTEVFRIDEEPPNMASESGKLWGGRFVGAVDPIMEKFNASIAYDRHLWEVVLFKASNSNKEGAVEKAGLLTKAEMDQIIHGLEKVAEEWAQGTFKLNSNDEDIHTANERRLKELIGATVMGSCTRDGAWNDQVVTDLRLWMRQTCLQRSRGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRTRLGVCLGGCAGLLMTLKGLPSTYNKDLQASGKAVFMAETKGVALNQLSLQELQTISPLFSGDVICVWDYGHSVEQYGALGGTARSSVDWQIRQVRALLQAQQA

SEQ ID NO: 791180 - protein, 47 aa, Homo sapiens
MNPCPCSGAIAGNPLGVDRELLRAGETSCPSSPGRITLSTRQDLQTH

SEQ ID NO: 791181 - protein, 35 aa, Homo sapiens
MAHYQQSSLSSVILHLPISGPCMVSGDDIDDSVLR

SEQ ID NO: 791182 - protein, 302 aa, Homo sapiens
RVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKALTHSEVGGERPEKFMGKFSGNVGPGKEHLKHIAERGGRGRIACRPSGEEEAQKRPNRRGPLPLFFGGLSGKKSHTWPRKFPGKGGILRGGKKCSLRPFADKNLFMGPT

SEQ ID NO: 791183 - protein, 190 aa, Homo sapiens
RVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINVSSSLTPEFPDSVGDISPPTPSQLNWLCSWL

SEQ ID NO: 791184 - protein, 64 aa, Homo sapiens [sequence omitted]

SEQ ID NO: 791185 - protein, 98 aa, Homo sapiens
EHTLGFLTAFISSMVWRGPRILMCSQSRYRVAGHQVLAGSQWMPRAHFCQDGLGIPLDLGGITMVDLLTHESPQEQDLRIFCGDINWIRKEPTRAGWT

SEQ ID NO: 791186 - protein, 273 aa, Homo sapiens
MIARRNPEPLRFLPDEARSLPPPKLTDPRLLYIGFLGYCSGLIDNLIRRRPIATAGYRKHMVTHLPNNFHPIPSKLFTNRLPPSSTDTCCSLNSDANHAPSLTRRTLHATSRLSDTLPTQTYVPRPPPPTHTPHPPPPPTHHTATKPPAAHRAPPPPPPAHTPPNPTSPHPPPTPPPPPPAPPPPHTTPTPPPHPGHTTRQPPPSNTTNSRPPHPPHHPPPTTHQTHPTHPPPPLHPQHLHPHTTTHTHTHHHNHPNPQPTQHHPPHTHSHNH

SEQ ID NO: 791187 - protein, 105 aa, Homo sapiens
MIARRNPEPLRFLPDEARSLPPPKLTDPRLLYIGFLGYCSGLIDNLIRRRPIATAGCIPSFYDIYPFFLAGNIILVKTLKTNLFCFEGNREIFGNILKFPSKEFP

SEQ ID NO: 791188 - protein, 194 aa, Homo sapiens
VSHSRLPLQDCVVVWLHFAEKGRGKVKPSSWTWVCSSLPDNVLPWGFCPGLQCGPLDPRKEAAQDGDETSIAPGPMHPLTLSRPAQTQSGTAAKTMDSWPQDPGRDAERGSPKTGPHKRHPFLTHRAHSSKDTHTHTHTHTEGKKHTEGERQREKGEWETQPHTQSYRGGREIHAPRQPLRLPGSALEGNNPRL

SEQ ID NO: 791189 - protein, 129 aa, Homo sapiens
MVAQEEDPDLFRLGAGVRVSPSPEGDLPDPGREGPTAGCPGGPRRGSGPRAKAAAPRKEPRTPLHAVPAAEATDPEVRAPPPRSLPSPRAARSGAGGGRQEGRRAQWGGPLPFPQRGPRSSSRVQARGR

SEQ ID NO: 791190 - protein, 107 aa, Homo sapiens
SHISVGSATGTISSTVLFSDYISRPEDHTSILHFDKNETQKTCQVLIIDDSLYEEEESFSVSLRLPVGGQLGARFPTTKVTILADRYDDGAEEFYSILLDSRKCLLP

SEQ ID NO: 791191 - protein, 156 aa, Homo sapiens
PSLPSCRRKSLCFLCSHRQPELGRPGLSGWGSFLCTQCVYVCARECVCQTLIASFRLGGLRCSREGIRISSCPCPRLFVPSPEQREVSSLAHTPGPDPGWEPPPPPPPQPSEPGFCPSASIPAHASAVPGGRRAVSRRLGLGPRPAAAGAKTYWSG

SEQ ID NO: 791192 - protein, 95 aa, Homo sapiens
ARWAQSQPRLFLLRLVPSFGPRRKTLISPHERLSVGVWTGASPTRLLTPDHKEAGSSSSASAANCRAFFSVFCPHFQLRTNQRTPNTSYHQPPDT

SEQ ID NO: 791193 - protein, 134 aa, Homo sapiens [sequence omitted]

SEQ ID NO: 791194 - protein, 103 aa, Homo sapiens
MAEGLGCILEQEGEGQVWIWGETGLRGIWEDDQGVGEPWLAAGGAVGCHEPRPAGGLQGRGRPLRCTQHTGAGTELGASMPHPQGLPTSGGTHPRPTLPSCFL

SEQ ID NO: 791195 - protein, 125 aa, Homo sapiens [sequence omitted]

SEQ ID NO: 791196 - protein, 378 aa, Homo sapiens
GGAASSALRHCPGRRAALGPAALGPSRGHGGQHASHGGTARGQPSKHQASSAGRPRAPAPLRPRSPAAAPPSPQTPRRCGGGAGLSAGRVARAQEPDGLSADFSSEYLGIENELEGNRGAALARLLPRTLPEHRSPARQRDLELPQSQPEPEAGVAPAMRGLCAAPRGSWPCPPCPLLCNKTCGGSTETHTCNSAASALKEVKRSSPEKPRDPGVLAEAPRMGRGAGPAPPQRKSPAEPGWAGAGGGGALGLLPWILRGRHRFPAQIRTQIRLPRLPRLQGAQSCSQLAARAPDGGSAHWPLPLLFLAPEIETVNLNSLDLLPLGPGGSRIQAQPGSLRRCRKPPTTPTRVRPILGQDAAVAEPLGVCNGELPRRWGQ

SEQ ID NO: 791197 - protein, 356 aa, Homo sapiens
GGAASSALRHCPGRRAALGPAALGPSRGHGGQHASHGGTARGQPSKHQASSAGRPRAPAPLRPRSPAAAPPSPQTPRRCGGGAGLSAGRVARAQEPDGLSADFSSEYLGIENELEGNRGAALARLLPRTLPEHRSPARQRDLELPQSQPEPEAGVAPAMRGLCAAPRGSWPCPPCPLLCNKTCGGSTETHTCNSAASALKEVKRSSPEKPRDPGVLAEAPRMGRGAGPAPPQRKSPAEPGWAGAGGGGALGLLPWILRGRHRFPAQIRTQIRLPRLPRLQGAQSCSQLAARAPDGGSAHWPLPLLFLAPEIETVNLNSLDLLPLGPGGSRIQAQPGSLRRTFKNPPTNAVAWMHCL

SEQ ID NO: 791198 - protein, 198 aa, Homo sapiens
GGAASSALRHCPGRRAALGPAALGPSRGHGGQHASHGGTARGQPSKHQASSAGRPRAPAPLRPRSPAAAPPSPQTPRRCGGGAGLSAGRVARAQEPDGLSADFSSEYLGIENELEGNRGAALARLLPRTLPEHRSPARQRDLELPQSQPEPEAGVAPAMRGLCAAPRGSWPCPPCPLLCNKTCGGSTETHTCNSAPPR

SEQ ID NO: 791199 - protein, 106 aa, Homo sapiens
TIPHPPPVASHGLILLVLLIPIKLSLLFLLTSAQKALGVACFHQRLPSSEGEVEASGVSSPEGLRTCSSEIAQAGQQPDGSGVARSVCRPWPGDSTEPVSKIGNGH

SEQ ID NO: 791200 - protein, 52 aa, Homo sapiens
MVFSRSRALGDLGSPPTVPAKLHVVLLADGLPACWHLLLCSSACVLPFVRPL

SEQ ID NO: 791201 - protein, 361 aa, Homo sapiens
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALVWFYI

SEQ ID NO: 791202 - protein, 300 aa, Homo sapiens
MEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALVWFYI

SEQ ID NO: 791203 - protein, 203 aa, Homo sapiens
MFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALVWFYI

SEQ ID NO: 791204 - protein, 464 aa, Homo sapiens
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSCNKITHDGMVYLADVLKSNTTLEVIDLSFNRIENAGANYLSETLTSHNRSLKALSVVSNNIEGEGLVALSQSMKTNLTFSHIYIWGNKFDEATCIAYSDLIQMGCLKPDNTDVEPFVVDGRVYLAEVSNGLKKHYYWTSTYGESYDHSSNAGFALVPVGQQP

SEQ ID NO: 791205 - protein, 303 aa, Homo sapiens
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGMQSVIAFATVLTQNQAIKAINLNRPILYSEQEESTVHVGRMLKENHCLVALHMCKHDIKNSGIQQLCDALYLNSSLRYLDVSW

SEQ ID NO: 791206 - protein, 242 aa, Homo sapiens
MAAQPPRPVGERSMGSSREAARAPARSPAWASTQASTPGAALAVQRESPESGLQKHYSNLCMEKSQKINPFILHILQEVDEEIKKGLAAGITLNIAGNNRLVPVERVTGEDFWILSKILKNCLYINGLDVGYNLLCDVGAYYAAKLLQKQLNLIYLNLMFNDIGPEGGELIAKVLHKNRTLKYLRMTGNKIENKGGMFFAAMLQINSSLEKLDLGDCDLGRVYSPCRPHVERKSLSCCTTHV

SEQ ID NO: 791207 - protein, 361 aa, Homo sapiens; identical to SEQ ID NO: 791201

SEQ ID NO: 791208 - protein, 361 aa, Homo sapiens; identical to SEQ ID NO: 791201

SEQ ID NO: 791209 - protein, 242 aa, Homo sapiens; identical to SEQ ID NO: 791206

SEQ ID NO: 791210 - protein, 46 aa, Homo sapiens
QGPPRVFSEEREAWNPDYSAEANGVSGGAQPVPGATRELRCDRVSG

SEQ ID NO: 791211 - protein, 342 aa, Homo sapiens
GHKVGGLAVVDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLYALAGAVGFFTHYLLPQLRKQLPWFCLSQPVLKPLEYSQYEVRGAAQVMWFEKLYAGLQCVEKYLIYPAVVLNALTVDAHTVVSHPDKYCFYCRALLMTVAGLKLLRSAFCCPPQQYLTLAFTVCLILIPGFPGFGEYLWPVWQWDVADGSAAMAGNGAFPCTWDWVVSGGFTHKRGFSLGTV

SEQ ID NO: 791212 - protein, 127 aa, Homo sapiens
RCLPLAHSCRALLMTVAGLKLLRSAFCCPPQQYLTLAFTVLLFHFDYPRLSQGFLLDYFLMSLLCSKVSWWLWPRPQAVQWEQSQLLPGWEENFLTVWPPLCSQPRGPLQQPLKEGVTSTLYREEAG

SEQ ID NO: 791213 - protein, 408 aa, Homo sapiens
GHKVGGLAVVDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLYALAGAVGFFTHYLLPQLRKQLPWFCLSQPVLKPLEYSQYEVRGAAQVMWFEKLYAGLQCVEKYLIYPAVVLNALTVDAHTVVSHPDKYCFYCRALLMTVAGLKLLRSAFCCPPQQYLTLAFTVLLFHFDYPRLSQGFLLDYFLMSLLCSKLWDLLYKLRFVLTYIAPWQITWGSAFHAFAQPFAVPHSAMLFVQALLSGLFSTPLNPLLGSAVFIMSYARPLKFWERDYNTKRVDHSNTRLVTQLDRN

SEQ ID NO: 791214 - protein, 61 aa, Homo sapiens [sequence omitted]

SEQ ID NO: 791215 - protein, 162 aa, Homo sapiens
MSQIGRVRLREARPLAQCLTVAQCRGKACVSSPFPEPAGSQGQHFRPQLCPVPVRNLKPAQPLPLIHAPQPGLQLHICIMGERGPGDLWLLLAYACVTDGREMKIGLRVPPSQGFEAVSPQGSHTMVETLKATGWEAKQSSEEVGEKGLEAGGGGRETANCG

SEQ ID NO: 791216 - protein, 86 aa, Homo sapiens
RPGEEQLHHEGLALMPPPAQLCMACPSGLSCPSCMWPQASPTQPSCFLWPCRVATRTPAGEGGCGWPVSELGFPPAWSPPHPLSYL

SEQ ID NO: 791217 - protein, 206 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEEPLSQESQVEEPLSQESEMEELPSV

SEQ ID NO: 791218 - protein, 186 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEELPSV

SEQ ID NO: 791219 - protein, 216 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESQVEEPLSQESEVEEPLSQESEVEEPLSQESQVEEPLSQESEMEEPLSQESQMEEPLSQESQVEEPLSQESEMEELPSV

SEQ ID NO: 791220 - protein, 141 aa, Homo sapiens
VDAPLPLSELSMALVNSVFLEVLGREHLWGLLLTPSSGNAGAHIYVFGGLRGGTTSLELDVCCSCLFGVCSVPFDSFQLSPPLQDLLKVSALLSQARGRSGSPYHKVLGGMWGLFLHRVQVNTSVASVLGCFLSPSNLITL

SEQ ID NO: 791221 - protein, 131 aa, Homo sapiens
WLCDSQASVCHRVWRWEGRRTALPHTGGARKSKPTLAYMCQQSDVGSCCGPRGSCSVGRECVGWCMATGATLLKLSASQARSVSAVGVVQASREPEIAQQAGMGMLGPWERPADQGELKSDRPHLMGKTTL

SEQ ID NO: 791222 - protein, 137 aa, Homo sapiens
MPCLFLRMPATFLGRWDWDGGGSGTLAISLAPAHQFPAAPQGPCSSGSSTLLLSNPMCLPQAAQAFSLVPTVTGSTASGDTAGSASLSPGPSISLLCLWGELRASVPWQRSLRSQRWPPMVLPHSAALEGRLRAALA

SEQ ID NO: 791223 - protein, 130 aa, Homo sapiens
NLNNVKTRTRLNIQFTSRNKWPTWGKDTLQLVFFSPWLQKAPRPWRRVLVALLIHGGGVLRPSRRLGFGKAQMGTCKHKNKRESNPHCTVSTPQLCKQIKWSISSGSSPSCLCVDAQARTCTHTHTHKPL

SEQ ID NO: 791224 - protein, 49 aa, Homo sapiens
MAHFPQLHAGLGGPLGNEQKPCPGHPDTVGEELYCREALNTHPLSVTGG

SEQ ID NO: 791225 - protein, 139 aa, Homo sapiens
LSGAESKPLCSMGIFLPLDLTVIYWPRERQARVRRGRRPQNRVDKSWPRARPVRPRDVSPAPATRVKLARTCLLRGFSQKCLVKAFVKESVFTCAGRAPALGPGRRRISELLESNPGKQNQPWTVGAPGAPCSLSKASY

SEQ ID NO: 791226 - protein, 160 aa, Homo sapiens
MGIGAVSAGEHRCSECRCRWAQVQWVQVQWAQVQWTQVGTGAVGAGTVGHRCSGCRYSGRTCSGHRWAQVQWAQVGTRAVGARAVGASAVGTGGHRCSWRRCSGRKWAHVQWVQVQWVQVPVGTGSNWAPGCKLSQGHQPRVSPHRLTSPKILKASPPSA

SEQ ID NO: 791227 - protein, 61 aa, Homo sapiens
MEPHTVAQAGVPQHDLGSLQSLLPRFKRFSCLILPKIWDYRNMNTALIKRNRYTPETGRKS

SEQ ID NO: 791228 - protein, 97 aa, Homo sapiens
AAPIRPSRSSLGHDRKSLGAQFCVPPRRFSGTAQETSCGSDTLVCCNFGRRKLESVGALTENGKRGPKFTEMLKCKPKNKFSFDFSPRGKLAKAHVL

SEQ ID NO: 791229 - protein, 69 aa, Homo sapiens
LALDHTASEWQSKPDIPGTCNYQQLLSPLCAYFLTCIIEVSKDSPRSPMVEAGGDCPSTPPRPLKAGPA

SEQ ID NO: 791230 - protein, 366 aa, Homo sapiens
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSLACYKKPPDYRDGVYKGLLAQLSGFLPRCFWMPSRHLVSIFRGWGQSTLHGCTIRGIILCLFCRHYSWSISLSYLSLSTRLYLFSYLASYYITVLLSHRLYHSSPRPYPPRLVFCFVLLCTLLLCYFYLSLLSLSCSPPSTLLLPIHHCAPSPIP

SEQ ID NO: 791231 - protein, 108 aa, Homo sapiens
AAGIGTREEQPFKFDFCMWIDFFTYSSMSEEVTYADLQFQNSSEMEKIPEIGKFGEKAPPAPSHVWRPAALFLTLLCLLLLIGLGVLASMCMYCPCFGQEEVSRISNI

SEQ ID NO: 791232 - protein, 234 aa, Homo sapiens
GEHMCFYENYAEIDFFTYSSMSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAW

SEQ ID NO: 791233 - protein, 107 aa, Homo sapiens
RKPQPGAADGAAQQVGQVQAMDSQQGPAGSLQSPKAPPNSAEQQLAASSKHRAQFCSSWPLSHIMLLKNRRKILQGLTLTLNRMHGGRSCTAACVEGSSHKRVMHSK

SEQ ID NO: 791234 - protein, 43 aa, Homo sapiens
MYWPSSSSRLNQLYSSEFCIFLFTKKRKRKRKHHFIRLCMFFS

SEQ ID NO: 791235 - protein, 126 aa, Homo sapiens
TLLNVVGLGCCELRRYPGEAGHPGTRMTRGRLRVALSAPSCGGEDARVLAGPCAGERDRGALSLRPAASRAQVHIGELGTQATQAVSGSRSYVIMSRAEQGRAPAFLAKPSCPLCTYTVTSKDFPK

SEQ ID NO: 791236 - protein, 312 aa, Homo sapiens
MPGPGRRAAASRRMKSSVGGRREKLLGAPKAQPSRDFTCVHDGESEAELIPDDFEEKPEREKKHTNFTLCNVCNIQLNSAAQAQIHYNGKSHQKRLKQLSNGTLKNDNGGTCQSPALPALVRPPAPPLQPSLDIKPFLPFPLDTAAAVNLFPNFNAMDPIQKSCNKPYIRGSSSPPKKADHIMQHLPSGDLILKPGCGPTTKGTKIAKEGSTALEAMKNKAEICNCPGQRPRITFTPSIPLPSITSSDQNRGGNNGAHGSRVGFNLTILARRRVLAGPGISRAHTVYTRKQRFVQRIPPLSGKSAYEPWEDS

SEQ ID NO: 791237 - protein, 134 aa, Homo sapiens
MPGPGRRAAASRRMKSSVGGRREKLLGAPKAQPSRDFTCVHDGESEAELIPDDFEEKPEREKKHTNFTLCNVCNIQLNSAAQAQIHYNGKSHQKRLKQLSNGTLKNDNGSCLEDCISYYILLNLRCHQFEDAML

SEQ ID NO: 791238 - protein, 63 aa, Homo sapiens
MAKRRRSVMSRYTSSWGSQRRGSCSVELRIFFTPCKVKEQRCQQRGAAAQLDRRLLFRFLEAA

SEQ ID NO: 791239 - protein, 141 aa, Homo sapiens
MPTCMNTHLPESPPAPMSTGTNAHLHPCPLAQMPTCTEAHPHKCPPAKMSACTDVHLHECPPVSTCTNTHLHRCPPARMPTCTKAYLRECPPAWMPTRTDAHLHSYPSEQPSGASFCLHMFKSSQSYSRLFLVGVILGMLF

SEQ ID NO: 791240 - protein, 104 aa, Homo sapiens
RCAVGVKLLSFSLGAAGKGPKHSEAEASLPRNPGSYNRQAQWPQSSLHLKGTIPDTTSLNTPWKMLSSLKVPSWQGAVAHAYNPSTLGGQGGWITRSGDRDHPG

SEQ ID NO: 791241 - protein, 84 aa, Homo sapiens
GPGYLEPPKTRASPPTKALRHNPKASHTTSTLKRHTPRPKIASAPSSTRCKQREDTTHSSSYSVTCISREHTFICAHRWYPPRR

SEQ ID NO: 791242 - protein, 100 aa, Homo sapiens
RYDLFTQCFEHVSISIDQIYKKLCRNNSAQVSSYIKEQTQDQFQMIVISLKEEFYSRADALIGIYPEYDDCMFSRVLTLDLSQYPDTEGQESSKRHGESR

SEQ ID NO: 791243 - protein, 83 aa, Homo sapiens
EVDAALDNTNIGKVSSYIKEQTQDQFQMIVISLKEEFYSRADALIGIYPEYDDCMFSRVLTLDLSQYPDTEGQESSKRHGESR

SEQ ID NO: 791244 - protein, 92 aa, Homo sapiens
WPSRQSPRCNKGTTLSQRLSGTVSSYIKEQTQDQFQMIVISLKEEFYSRADALIGIYPEYDDCMFSRVLTLDLSQYPDTEGQESSKRHGESR

SEQ ID NO: 791245 - protein, 32 aa, Homo sapiens
AILDPCVRKSKSSSPLIFTILQLSFWFPSVVI

SEQ ID NO: 791246 - protein, 101 aa, Homo sapiens
LVPEGIPASKHSAFDRNVIDDKRTRYSENCRLIFVPLNSSLLQPLHQSFFVLFCFSRGRISQSPRLECSDTIIAHCSLKLLGPGESLGPRRRRLQRAEIAP

SEQ ID NO: 791247 - protein, 111 aa, Homo sapiens
ARELKGPPLPPSTPDADSEAHKRGAVRQPVRRGGGTLRPSREKAAAAAAAAAARRGAKPVLRLSGRPGRERLHVGLHWRKAEAFRGLGLFYDHHHYFILPVAQKGSPAPIP

SEQ ID NO: 791248 - protein, 132 aa, Homo sapiens
EAGVSGMRTSRARSLRVPGSRVLPFPGDSPNYRNWPKFSISRLSLGKGAEEVPATRRATTERATDSPRLGSGPAQPPPLPPVRAPSRAPRPGLHPLRRSGSGRAGLRRPHPRPGSEAGPSGALRASGLHAAA

SEQ ID NO: 791249 - protein, 129 aa, Homo sapiens
ASPTPETQPLGAEKLSPPGPRARDAGAQQRGGAPRWPGAARGPALVPRARRRYEDTDAVAQLPSPAAIPEPGSRPPLGPAQAASPRRGVPPRYPPPRRPHKQVLEVRRQEAGRSAGAGGGPGSGQRLRP

SEQ ID NO: 791250 - protein, 116 aa, Homo sapiens
MCRSIDASFGFEMEMFEFLNICQAHGFPKILGVLTHLDSFKHNKQLKKTKKGLKHRFWTEVYQVAKLFYLSGMVHGEYQNQEIHNLGHFITVMKFRPLMANFSPLYPGRQLKGWKI

SEQ ID NO: 791251 - protein, 116 aa, Homo sapiens; identical to SEQ ID NO: 791250

SEQ ID NO: 791252 - protein, 116 aa, Homo sapiens; identical to SEQ ID NO: 791250

SEQ ID NO: 791253 - protein, 73 aa, Homo sapiens
LDSSNPPTSPSQSAKITHMSHHTRHIHAFCWVKRELVLEKVKEKRIFNDFLITLIVNLTVIKEIIKKNFDKMT

SEQ ID NO: 791254 - protein, 71 aa, Homo sapiens
PCPPSGPVPAPPRAPPAPPTLSSTHDGPAPVSSYRRFENPKSDLPCPRPPCIYRDPQNKTLSRARRGGLRL

SEQ ID NO: 791255 - protein, 161 aa, Homo sapiens
RLVRAEGSGAGAARGCRPRSAAVRAAGGSRCLGPRAGWQPAAGTERGRAAGCAPARGFSLEAEGQTWGPVAARPHRPAAGRVLLRGGDTAPRAARGFLLEEGNGEFEGDCSMLEDKGHCSLGASRRRRGGVRSLPLRPELGLWLLGPGTQRGAGAGRPTAQ

SEQ ID NO: 791256 - protein, 872 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAAKGRKWQRESYDSDEYVYVCNPKRSERLGVMKAEWKQKGSQSPKCDSQAEGQAVSTDGARKEAQIRGHAGSGQGEEAVQKSHKPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 791257 - protein, 169 aa, Homo sapiens
RYAAAAAAAVAAAAARRVERGSGASGGMTRRRSRPSGGAGRRERARAAGPQKPQAPEPPPPPSLEAGAGAGPPEAPAEPDHDGPREDDEPNLVPGPQVGASGETSAARALSPSPSGSGSGAGLGMGHPAAAGVAAFPRVRRRSFLPRGGNGGWTPLPKAEARSALLRLG

SEQ ID NO: 791258 - protein, 789 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 791259 - protein, 789 aa, Homo sapiens; identical to SEQ ID NO: 791258

SEQ ID NO: 791260 - protein, 925 aa, Homo sapiens
RVLSTYLSRPRPGPPASSQPVQTCCLLCHRERKGWEEGGGDMHNSRDSTRRLSRAMPSGCTSLPESPAARCSVGRRGKKLTGIEHLLCAGPGQVPPASSQPVQTCCLLCHRERKGWEEGPSQNGLVLQGEKLPPDFMPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 791261 - protein, 768 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKSTLGGRGGWIT

SEQ ID NO: 791262 - protein, 789 aa, Homo sapiens; identical to SEQ ID NO: 791258

SEQ ID NO: 791263 - protein, 698 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKDETDREVEYFKWPCLDSGVPS

SEQ ID NO: 791264 - protein, 169 aa, Homo sapiens; identical to SEQ ID NO: 791257

SEQ ID NO: 791265 - protein, 169 aa, Homo sapiens; identical to SEQ ID NO: 791257

SEQ ID NO: 791266 - protein, 849 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNARSERLGVMKAEWKQKGSQSPKCDSQPRDEAVSTDGARKEAQIRGHAGSGQGEEAVQKSHKPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 791267 - protein, 794 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKSIFGQARWLMLLILALWEAEAGGSPEIRSSRPAWPSW

SEQ ID NO: 791268 - protein, 786 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKRFCLDSAKQTRQKVAVNWTNFSLKGILRP

SEQ ID NO: 791269 - protein, 784 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPPGPARPQSLPQGKGRSRRSRNKQEKPASSLDDVFLPKDMDGVEMDETDREVEYFKSAGPTLLSLCLVFLFLFLFCFFPILYF

SEQ ID NO: 791270 - protein, 153 aa, Homo sapiens
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQLAPELAARP

SEQ ID NO: 791271 - protein, 169 aa, Homo sapiens; identical to SEQ ID NO: 791257

SEQ ID NO: 791272 - protein, 101 aa, Homo sapiens
PSLWAWSCLTHGWEWPLVVPQPVVLRGHPSCSSVAAPGLRSQDSQECGRGHPESFGLWGLLEKQNQVGGAEGTLATHRHHHLWGPQSLCNNLVPQSSSAFE

SEQ ID NO: 791273 - protein, 58 aa, Homo sapiens
PPSSPALAPPAPGRALLDPDPEPAERRARLSAPPGPLPSTGRENRGAPLSSSPRYERP

SEQ ID NO: 791274 - protein, 187 aa, Homo sapiens
DLPDGHCQAALPAFRALDRGPFKLPPRPGQDAATAQRGSQRTPSEPSGLYFHFFLAGRNFLLLRKTSLNRATNGSRVSRTSPARRNNSAMSCVEWIGSTWSLFPFKIPQGLSLEEPGCLINHAGTFIRSSVCEQKPEGEGGGPLGPPESGPTGGLDKRRDLSLEHLLHAPEVLTHPGPAGEVPQDLP

SEQ ID NO: 791275 - protein, 31 aa, Homo sapiens
EESMGCLLSLRGSAMCLVMPYLLTLSPCCWP

SEQ ID NO: 791276 - protein, 100 aa, Homo sapiens
VLIELQSSSWRAGSQHGAYRPVDTVPSGYQNYRQMSMPTHINWKSHCPGPGTQAGHVVFDARQRRLAVGKDKCEALSPRRLHQEAPSNSGKPSRSGDIRM

SEQ ID NO: 791277 - protein, 76 aa, Homo sapiens
QPPRRLTQGTGLKALSPSAPHTPPRPAGNLPREPALAVGDGKASPGFLDLSLFGRAKKNPRPGTVAHACNPSTLGG

SEQ ID NO: 791278 - protein, 117 aa, Homo sapiens
VRFCFHCDKAASNSMQCLTIAALSLFQAQRFSLYATKPLPWDGDRWHQQLKTVFPTLFIASFNSMKLKSDYPGRGSCKDLGFSGPSNSKYRQEQLPNLHTTDLSTRRQMEPLFSSEF

SEQ ID NO: 791279 - protein, 30 aa, Homo sapiens
MDLRWGVALSCDRSSRQPWTRGHEQSSHFS

SEQ ID NO: 791280 - protein, 41 aa, Homo sapiens
DEFSDFKDLQMSVVEIASGGFMLTLKYSILEGMWLLIASYQ

SEQ ID NO: 791281 - protein, 127 aa, Homo sapiens
QGLGVEKMTYSGLSNMKFVLIRFHTVRKKYLILGNYKEKRFNWLTVPHGWGGVRKLTIMVEGTSSQGGRRENERQAKKEKPFIKLSPPASVRSLTPVIPALWEAEVGGSRGQEIEIILANTVKPHLY

SEQ ID NO: 791282 - protein, 449 aa, Homo sapiens
RAAGNCFPEPGFVKQLSAAAAVVAPAAAATEGSIPDTGKMEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRVLEAGKANVILPKSSPSGITHVIASNARIKAEKEKDNFKAPFYPIQYLGDFLLEKEIQNDEDSQTNSVWTEHSNEETNKDFRKDAGFLEMKGALRETMYRTQKEMQNHEDVNVGSILIQHHKKEKFSGSSKDLKFVKMRNTFGSHTYENQKEIKKKDEDIQRSYTLRRKRKKGKESNCKKGVEHEKIKSTLRRHIYNRDQKEMKNSIFAEYAKESKAMAIKTDVDVVEIKNTLRKHIYRAQSFGGWKGKCHFTKKFTKWNNSCDCQ

SEQ ID NO: 791283 - protein, 462 aa, Homo sapiens
RAAGNCFPEPGFVKQLSAAAAVVAPAAAATEGSIPDTGKMEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRVLEAGKANVILPKSSPSGITHVIASNARIKAEKEKDNFKAPFYPIQYLGDFLLEKEIQNDEDSQTNSVWTEHSNEETNKDFRKDAGFLEMKGALRETMYRTQKEMQNHEDVNVGSILIQHHKKEKFSGSSKDLKFVKMRNTFGSHTYENQKEIKKKDEDIQRSYTLRRKRKKGKESNCKKGVEHEKIKSTLRRHIYNRDQKEMKNSIFAEYAKESKAMAIKTDVDVVEIKNTLRKHIYRAQAVRYNCIRIDKQPVYNVEVKNAEFPRGVLNLIESLIEG

SEQ ID NO: 791284 - protein, 107 aa, Homo sapiens
DSVSRKKQTKAGKALGGLCSRLTWTQPWLDSAVQAPSHKQKAALRTTQRWDLRGCCLLVNSGSTISVVTLDRSLNFSEPLFPYLQSGVSLRAAARMVEVEAEGNCQC

SEQ ID NO: 791285 - protein, 166 aa, Homo sapiens
VGGEGMAEIKHGDYPTISGSYPAAVDMTANPPENGFAALHGSALPPHLRLAQRHTSVVIGSSLAETRVGTEMASLTADFSGQQLCARRREGRAHWRCGARQGQSASGRRCKPDRSTDTCRDVPSRQLAGTWERVGSLAGGEPGLRETARGRVREWRRSPDPRAHAA

SEQ ID NO: 791286 - protein, 793 aa, Homo sapiens
MEARVERAVQKRQVLFLCVFLGMSWAGAEPLRYFVAEETERGTFLTNLAKDLGLGVGELRARGTRIVSDQNMQILLLSSLTGDLLLNEKLDREELCGPREPCVLPFQLLLEKPFQIFRAELWVRDINDHAPVFLDREISLKILESTTPGAAFLLESAQDSDVGTNSLSNYTISPNAYFHINVHDSGEGNIYPELVLNQVLDREEIPEFSLTLTALDGGSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLVLDANDNSPFVLYPLQNSSAPCTEPLPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLRLPEAAPDQANSLTVYLVVALASVSSLFLLSVLLFVAVRLCRRSRAAPVGRCSVPEGPFPRHLVDLSGTGTLSQSYQYEVCLTGGSGTNEFKFLKPIIPNLLPQSTGREVEENRPFQNNLGF

SEQ ID NO: 791287 - protein, 793 aa, Homo sapiens; identical to SEQ ID NO: 791286

SEQ ID NO: 791288 - protein, 121 aa, Homo sapiens
KKHLQLLNGGWVATVPALGARFIPRDQPSADLGIWSEWSCWSWEQACSGHRSSLYRKAPSFRCPASTEESKGVFLNLYPVMCSHSSFDGPQWSQDSVCSKRMAKASLSCVSYWVEFYVVTR

SEQ ID NO: 791289 - protein, 117 aa, Homo sapiens
GRRPCSDRAPGLAASCSPALPAQLLGEAAPPTHPNHMSTGIQRPRSPWRPGERRQGVPEKEEGRAQAAAFLLCLLCQQLSPSTGRSLGRTEGCHKELLNRSKGIEGWSDMIYDLPNP

SEQ ID NO: 791290 - protein, 83 aa, Homo sapiens
KDESYFSVWCLAHSAGVQNHQRLDCRCNICSRKADLTHVEAPFPHLLSQDADGVAFRDCYTDRVLEGCVARKRCCADVRGLYL

SEQ ID NO: 791291 - protein, 604 aa, Homo sapiens
QEYILNLFQRYVDEGLHFINKKCSQAIPQVDISKVTTLCCLLESLILGKDGVNLAMEQTKLNTILCQTFVFCYLWSLGGNLTENYYDSFDTFIRTQFDDNPDARLPNSGDLWSIHMDFDTKRLDPWERIIPTFKYNRDVPFFEMLVPTTDTVRYGYLMEKLLAVKHSVLFTGITGVGKSVIAKGLLNKIQESAGYVPVYLNFSAQTSSARTQEIIESKLERKRKNILGAPGNKRIVIFVDDLNMPRLDRYGSQPPIELLRQYQDFGGFYDRNKLFWKEIQDVTIISACAPPGGGRNPVTPRFIRHFSMLCLPMPSEHSLKQIFQLNGFLSDFPPAVKQTASSIVEASVEIYNKMSVDLLPTPAKSHYVFNLRDLSKCVQDKHFGIAIDLEYFLNKPIIFGDFIKFGADKADRIYDDMPDIEKTANVLQDYLDDYNLTNPKEVKLVFFQDAIEHVSRIARMIRQERGNALLVGVGGTGKQSLTRLAAHICGYKCLQIELSRGYNYDSFHEDLRKLYKMAGVEDKNMVFLFTDTQIVVEEFLEDINNILNSGEVPNLFEKDELEQVLAATRPRAKEVGISEGNRDEVGCARVVMWLYHKNVSSPFI

SEQ ID NO: 791292 - protein, 84 aa, Homo sapiens
ADRSPEPSREDAPLKMTLLGVHEEGEATEGWRAPGLEEELESVPCHDPQAAGATAQSGTVTLAPSFTCAFSSHIPGRLARLCQL

SEQ ID NO: 791293 - protein, 126 aa, Homo sapiens
AVVKKAAKRSSTADSCKTAPGCTESRAVESPGALTRRPRGDEKHPNLLLRKARGQGSAITAATVCTVLKSIKSQVHHLGKSAVATGNIRIYPPALRWFPERMRELTLSTLLGALSIFTHSVLTSPL

SEQ ID NO: 791294 - protein, 113 aa, Homo sapiens
YSSYKVAQQNRENNWLKSYKHICYRLHVCRWSQGSVCNHSCLRIGYTGFFMKLTFKSFIPTGSQSSAVFLLGCCSFPLLKLEGFLVYFLILSSPPGFCCETATQFAFFLSTLQ

SEQ ID NO: 791295 - protein, 93 aa, Homo sapiens
LNLFNSILYRSNIVPESAEAARKEVSSRTKLHIFLGRSASLLRPNGHSLARWLETTVPERTQGKISRRNPNRKIYDWEAKGFAKAWGKEDLYV

SEQ ID NO: 791296 - protein, 30 aa, Homo sapiens
MSPNARVWTYFHHKPQRELPEEQGLPGAPT

SEQ ID NO: 791297 - protein, 114 aa, Homo sapiens [sequence omitted]

SEQ ID NO: 791298 - protein, 135 aa, Homo sapiens
SDVAPCASPSKTTICGMAPPWPLHSCPPPAGRGFLPALSIHSFHLGLVILATAAPPWCSAKLCCLQAAPSWTLSLTQITSFLLHSPPPCSASSLTQLKVHGHGHPLTMPSSLPVPSGSTVLTAQPCPYLHPTLHL

SEQ ID NO: 791299 - protein, 81 aa, Homo sapiens
SQRSKVHAGHVSEDEIMDGSHTWSPPSFHLASSPSIPPCSEGISSADGGWPAVYLDLLGSEISCAWLLHFVSILGKDAEVC

SEQ ID NO: 791300 - protein, 37 aa, Homo sapiens
GPSRLGSRDRMGGIRGLESAPGSLPATRIPAPFRPFG

SEQ ID NO: 791301 - protein, 125 aa, Homo sapiens
MAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQ

SEQ ID NO: 791302 - protein, 106 aa, Homo sapiens
MRTTPEAADQVRAAPGPTPPDCPPSHSTPQERKLLEDRLAEFSSQAAEEEEKVKSLNKLRLKYEATIADLEDRLRKEEKGRQELEKLKRRLDGESSELQEQMVEQQ

SEQ ID NO: 791303 - protein, 356 aa, Homo sapiens
MYRSSGSDIEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADLEDRLRKEEKGRQELEKLKRRLDGESSELQEQMVEQQ

SEQ ID NO: 791304 - protein, 124 aa, Homo sapiens
RYWTLTYLALPTVTDQEASSMPSTGDSEATPSPPTGNSESAPVPATGDSQDAPVSPSGDSEAPPYPLRVTLRPVPTLGDTEAAPVSPTDDSEEAQMLQSLVSSVPSALVSRGREGATPGAPLPS

SEQ ID NO: 791305 - protein, 229 aa, Homo sapiens
MATGALLPCSRPCPMSRLDFLKASHFSLGPDLRLHEGTMRTTSHRDFAYPAATREPPSLQPPPALLFPMDPRWDREERVSEAHRAFPPPSTPPWELLQAQARERTLAMQAGNLHLHEDAHAGIGLSNAHAAYGWPELPARTRERIRGARLIFDRDSLPPGDRDKLRIPPTTHQALFPPHDARPQPRAPSCHLGGPNTLKWDYTRQDGTSYQRQFQALPGPPALRCKRVN

SEQ ID NO: 791306 - protein, 82 aa, Homo sapiens
MVIFTILILLIHEHRRFSICLYHLWFLSSVFCSSMCRDLSPLWLSIFLGFFLKLLWFQVLHLTLFLFSKKGVACCQRSFNFT

SEQ ID NO: 791307 - protein, 106 aa, Homo sapiens
VCGWHSPATPSRPLPRRCTPRARQARGAGVASQQGAQAATSPQGTPSTQAGRDDTNVRRGVSGVTGRQNERRGPHCLEGITRNPRYSAGRWVRRLAPRTLEAWKSR

SEQ ID NO: 791308 - protein, 66 aa, Homo sapiens
ACACSPESPPALEGKEPGHGATAAGATTLAQIFPAGMTIHWVLGLGPLDPQTEPRGYREKLKYIPP

SEQ ID NO: 791309 - protein, 127 aa, Homo sapiens [sequence omitted]

SEQ ID NO: 791310 - protein, 430 aa, Homo sapiens
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 791311 - protein, 430 aa, Homo sapiens; identical to SEQ ID NO: 791310

SEQ ID NO: 791312 - protein, 137 aa, Homo sapiens
MTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAY

SEQ ID NO: 791313 - protein, 74 aa, Homo sapiens
KDQTSSSVIVGLRLNKEAPIKTKSMWPPGEHIATDAICEMCKTLAGTRPVSLLQTWRSVLKLFSKQNLSTTKVP

SEQ ID NO: 791314 - protein, 159 aa, Homo sapiens
MRKNESYLNQPAPPIPIPTLSLMGGCREHFENHWKGRARWLMPVIPALWEAKAGRSPEVRSSKPAWPTWRNPIFTKNTKISQVLELFLNYQSLICALEKQKRQKGSLAIFCWSFQGGCVSKRPDVPSLKSQKPKRKRITGRKRLSKGFWSLLFSNLGRF

SEQ ID NO: 791315 - protein, 159 aa, Homo sapiens; identical to SEQ ID NO: 791314

SEQ ID NO: 791316 - protein, 159 aa, Homo sapiens; identical to SEQ ID NO: 791314

SEQ ID NO: 791317 - protein, 159 aa, Homo sapiens; identical to SEQ ID NO: 791314

SEQ ID NO: 791318 - protein, 322 aa, Homo sapiens
AQRWALGRLRRSTRLVRTKWARGGREKGRAKMAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSEYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 791319 - protein, 322 aa, Homo sapiens; identical to SEQ ID NO: 791318

SEQ ID NO: 791320 - protein, 121 aa, Homo sapiens
MIEFDSYPPGGELYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 791321 - protein, 94 aa, Homo sapiens
DAWVDPRVAAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 791322 - protein, 316 aa, Homo sapiens
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSESLHGPRDFWSSSQHISIEGQKEEERYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 791323 - protein, 128 aa, Homo sapiens
MGGRFNTLFPSPYRPSTSSEYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 791324 - protein, 148 aa, Homo sapiens
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVGKYHGVAMFIVFRN

SEQ ID NO: 791325 - protein, 106 aa, Homo sapiens
LSLPNYMNGPLLPFGVQEKPTSININIDLKSDKKYLQSILSEDLLPGGLICMMKPWPPPPLIITQTFIYIDNNSFNQLPIRQFLNPPMTWKPPPFLFVPPFQIQPM

SEQ ID NO: 791326 - protein, 128 aa, Homo sapiens
AAGTCAFCPVPSTPVEHPTFLPVLHKHRLLQGCAPWNGFPEPPQARAPAGLRPLNGFAEPPLAQAPAGLCPLERLRRASTSTGSCRAVPPGTASHCRAAPPGTASQSLHQHGLLQGCAPGTALQSLPG

SEQ ID NO: 791327 - protein, 108 aa, Homo sapiens
KQVSWAQWLPPVILALWEAEAGLELPMSSDLPTSASQTAEITGMSHHAWPRLCSFACGYAVFPSPFVGETFFSLLSSLGTLVKDHLSIYVRVYFWVFVLFHWSVCLSL

SEQ ID NO: 791328 - protein, 107 aa, Homo sapiens
PLGRGGAVALCAVRPPRECSCELITAWRACVPHTSSRTALIPTPTPNCQPLALAPSFQGASAGPGTCHLLSQLHMGFPKRPILPASHFWFAQFTLRKPICLPVFLVG

SEQ ID NO: 791329 - protein, 847 aa, Homo sapiens
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 791330 - protein, 889 aa, Homo sapiens
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 791331 - protein, 847 aa, Homo sapiens; identical to SEQ ID NO: 791329

SEQ ID NO: 791332 - protein, 847 aa, Homo sapiens; identical to SEQ ID NO: 791329

SEQ ID NO: 791333 - protein, 847 aa, Homo sapiens; identical to SEQ ID NO: 791329

SEQ ID NO: 791334 - protein, 847 aa, Homo sapiens; identical to SEQ ID NO: 791329

SEQ ID NO: 791335 - protein, 353 aa, Homo sapiens [sequence omitted]

SEQ ID NO: 791336 - protein, 118 aa, Homo sapiens [sequence omitted]

SEQ ID NO: 791337 - protein, 847 aa, Homo sapiens; identical to SEQ ID NO: 791329

SEQ ID NO: 791338 - protein, 847 aa, Homo sapiens; identical to SEQ ID NO: 791329

SEQ ID NO: 791339 - protein, 133 aa, Homo sapiens
MIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 791340 - protein, 176 aa, Homo sapiens
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLITSFGFKMSFEQLEQVFLVRGGGGRSGGTVYPVRHSVEQNS

SEQ ID NO: 791341 - protein, 135 aa, Homo sapiens
MCLRVYRRGLPVLDISSMLCVSTLPEWRHMPYGSAGIPMSAPVNECDIPGHCQHGGTCLNLPGSYQCQCLQGFTGQYCDSLYVPCAPSPCVNGGTCRQTGDFTFECNCLPETVRRGTELWERDREVWNGKEHDEN

SEQ ID NO: 791342 - protein, 114 aa, Homo sapiens
GLRPLSAAGHGRSPARPHTVPAPVWPQPTPRRHWADGGGGSCLPAFGRAERSAPDRVRLPSGIGTRGALKFGESRSRREGMRSPLSGGAEWASFQPLRRQDFPSCALHRGLPSP

SEQ ID NO: 791343 - protein, 110 aa, Homo sapiens
LCVVVEDWHWETWEAKSWAWPGQASGFQELLVPGDTQWGKSWLLGGPQPRAGRPSSQLWSLLTSALWLLMHFSSSSLAAPADAEATPASPAMYYLTSYQPPQDDALCFHR

SEQ ID NO: 791344 - protein, 104 aa, Homo sapiens
MASSRRGCARLLTESIKKVLHGGVQQEKQGTSMPPDPAGPARVTRAGCSVSLGLSCHPNPFNVFLMLPAHRFVFPFLSPLSKGLFYFTHFVLLLLPLTCISILF

SEQ ID NO: 791345 - protein, 94 aa, Homo sapiens
VESPYQQEGSHQMWPLDLGCSLQNYSRSKEPSASLVVWKNWDSPQCSGNSWESRTTYFPSTTSKALQRTEPQSCQYTMNNAKISRNPKAYFSMY

SEQ ID NO: 791346 - protein, 30 aa, Homo sapiens
MLKGTLVILISVPIIVEFHSTASQALLVLT

SEQ ID NO: 791347 - protein, 37 aa, Homo sapiens
LSTLPPCEDTATSCPLGSRKQLSPDIKSASTLILDFP

SEQ ID NO: 791348 - protein, 159 aa, Homo sapiens [sequence omitted]

SEQ ID NO: 791349 - protein, 305 aa, Homo sapiens
MRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 791350 - protein, 305 aa, Homo sapiens; identical to SEQ ID NO: 791349

SEQ ID NO: 791351 - protein, 305 aa, Homo sapiens; identical to SEQ ID NO: 791349

SEQ ID NO: 791352 - protein, 305 aa, Homo sapiens; identical to SEQ ID NO: 791349

SEQ ID NO: 791353 - protein, 314 aa, Homo sapiens
MCLEMAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 791354 - protein, 176 aa, Homo sapiens
QVLGAPCHFPAALPRGSRRRGEVEPRELGRGPRLVVAAMTAARDWLLFRAPPAGGEGKMSMSGFKGKPKLLASIFQENQEPQPRLTPHRNIKITSGHLSQQDLESQMRELIYTTQILLSPPLLTIQRCRKHSDKWAKVARVIGLLASHKTDLQENTPVVEAFPNSPRTPTLPGVLT

SEQ ID NO: 791355 - protein, 168 aa, Homo sapiens
QVLGAPCHFPAALPRGSRRRGEVEPRELGRGPRLVVAAMTAARDWLLFRAPPAGGEGKMSMSGFKGKPKLLASIFQENQEPQPRLTPHRNIKITSGHLSQQDLESQMRELIYTTQILLSPPLLTIQRCRKHSDKWAKVARVIGLLASHKTDLQENTPVVEVMSFMTEM

SEQ ID NO: 791356 - protein, 137 aa, Homo sapiens
QVLGAPCHFPAALPRGSRRRGEVEPRELGRGPRLVVAAMTAARDWLLFRAPPAGGEGKMSMSGFKGKPKLLASIFQENQEPQPRLTPHRNIKITSGHLSQQDLESQMRELIYTTQILLSPPLLTIQRCRKHSDNSNC

SEQ ID NO: 791357 - protein, 106 aa, Homo sapiens
MAAPGRAQGHRPAGRLNKQKRRRGPGGGVPALLGFRGELVPPAGAWWERGDNPPRQKRLREAPGLPRPLGPGRGRQRRNLAAERRERRAGAGRDKMRTARAGPGAA

SEQ ID NO: 791358 - protein, 102 aa, Homo sapiens
VSHQFFFSNSSHNHPSSFNPAPPPHGSWVHKILHLHMRAPTQQGVGYTVSPQQTQSTFPHYISAFVLCQACTSEYRSQLASFDCKPSSSSGSTCRLATHSLC

SEQ ID NO: 791359 - protein, 70 aa, Homo sapiens
LPAGVGPLREGAEPLLPGPGPGASLRPAGPNLSHCQCGVPHSSAFWSRGCAEAGEWEKFERERVKGSPGP

SEQ ID NO: 791360 - protein, 102 aa, Homo sapiens
CSNSGLNFKVTQINIFDHSDLSSLIYFCSITKFLALANQLIFSYLLSFQASLLWLMPSSCPKMPSPLCSACVAHIALKGHHKFHLLLKLFLTPIFLWQVFNL

SEQ ID NO: 791361 - protein, 101 aa, Homo sapiens
TDSMTPYGTPSCLHHASPLGLCLLMSADGLPLAHTSIKGQGPPCLVPHDAAHMAPPASGPLSPQISTSVASLLTSAARAPVSTRRAALSASVFPATRVASC

SEQ ID NO: 791362 - protein, 154 aa, Homo sapiens
LASAQLDDAGVYTAEVIRAGVSQQTHEFTVGVYEPLPQLSVQPKAPETEEGAAELRLRCLGWGPGRGELSWSRDGRALEAAESEGAETPRMRSEGDQLLIVRPVRSDHARYTCRVRSPFGHREAAADVSVFYGPDPPTITVSSDRDAAPARFVT

SEQ ID NO: 791363 - protein, 127 aa, Homo sapiens
GQLRLGRRFLEGWDGDEGLRVRFLFQLAESSLWERGRVRREEAGAEALLPSLCGVTLGCLFSVSEPRLVREIMNVKGGALAGPSLSVNGVELFGAILLASLKGDVKPCFLLNSSGTIKNANMPNKCG

SEQ ID NO: 791364 - protein, 482 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGIPPHVKAPVSQPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791365 - protein, 109 aa, Homo sapiens
GRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHR

SEQ ID NO: 791366 - protein, 559 aa, Homo sapiens
GRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGIHPMLKHQSHSQESKLNQKFNLSHLVCVNNDLENDLVFLLEDQDQAEEIMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791367 - protein, 242 aa, Homo sapiens
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKS

SEQ ID NO: 791368 - protein, 109 aa, Homo sapiens
MNCGLTVCSQPLSAFHSVTAIFPCKIGGGERVGLLGEVLDLSAICFVPWVSPEIRAFGWVCSLKVENGFCLRGCVSITSSMVCCYSTSRLPFEHPFRKERKVNKLHFTH

SEQ ID NO: 791369 - protein, 72 aa, Homo sapiens
AHFLLLLPWKKRLSPPAVILRPFQPCQTQNVTEKQKHLEYVTEVIKKSHVICACFPFCHDCKFPDAFSAMQN

SEQ ID NO: 791370 - protein, 125 aa, Homo sapiens
AHFLLLLPWKKRLSPPAVILRPFQPCQTQNVTEKQKHLEYVTEVIKKSHVICACFPFCHDCKFPDAFSAMQNSCFKHLQEDTLYNCINRVCSLTLLLRLESVAQSQLTPTSASWVQMILLPQPPK

SEQ ID NO: 791371 - protein, 142 aa, Homo sapiens
HCPVDPLIWLFICILSKLVNGPLDGAASLVEEATLVLQGNQDEMATRDPWVWMASLDFQARKGKRETKDKMELLGLRGPLDLLGPGALLATLGKMAPGEHKAQRAPKESPDKTARWAQRDPQGPRVSLEYLVVNKIFPGNLE

SEQ ID NO: 791372 - protein, 47 aa, Homo sapiens
AVSSVKGEVVFVIHQDLSRAVPSLHWGSGLPAWGPTAGFATSTVLRT

SEQ ID NO: 791373 - protein, 110 aa, Homo sapiens
VRGWRATRGPLLQAWFGITDHPADTLPVSICTEEFAGCGLQPTHPNHRHALSPPFGPSNNSMPRTFYCPGLSGSLRRPDRPSPPQAFVQPLLHARPTLVRLCRAELLVIL

SEQ ID NO: 791374 - protein, 55 aa, Homo sapiens
HGASSVFTSSPEGRRQSQWCQVWTVWPDPKTRSQSQIAGPCSGTIVSREAFIISL

SEQ ID NO: 791375 - protein, 115 aa, Homo sapiens
MVTASQPPGRTIVPPLSWLGPGRGCQICFVHVKCGGIMSPSNQIPTKIKTKQIKRLSEDSPEGSVVSAWEPGSLVDLTCFSDFAMFIADVPVLVLATHLHYRLILTTSRCGMQWF

SEQ ID NO: 791376 - protein, 506 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATAYYKVDDPVWNIQIARMLELPTIYRKVYDQPFHSSALEKEEALRGENPGGMRMCAYLLIYDKRTLRGDTENRNPGALDLPSLTSLLSEKAKEFLMENRVQSFYQQELEMVESLLSLANQPVIHSACSDQVNFKKDTTSKAIHSIFKNAIQLLQDKGLVFQKDDGFDNLYYVTREDEDLHRKIHRIIQQDLQKPNHMAEGAVTSWKSWACARLDIPPGLSEVLLEPKVLEDPGREPQWPMVRTTGGLIITKLSSKRTRRTTLWGDHHTKRGRYNPPGGQTYTPLITGGDHTSEAQTPTTEVSNYILGHERGNTGWALIAKNSAEERRIQAEQQNTPAPPDAGHNNETARVRILRNHS

SEQ ID NO: 791377 - protein, 153 aa, Homo sapiens
MQPGSSRCEEETPSLLWGLDPVFLAFAKLYIRDILDMKESRQVPGVFLYNGHPIKQVDVLGTVIGVRERDAFYSYGADDSIWSYKLHLLPVNPESASAVPRVARELSLTLLTYRTYMATIGHAHRMASRLHRPRRQTQLFRYIPPDYRLDSMP

SEQ ID NO: 791378 - protein, 512 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATAYCKHKIFYQIGGFSGCASSKPLVQLEVKLSKSSVEDKVDDPVWNIQIARMLELPTIYRKVYDQPFHSSALEKEEALSNPGALDLPSLTSLLSEKAKEFLMENRVQSFYQQELEMVESLLSLANQPVIHSACSDQVNFKKDTTSKAIHSIFKNAIQLLQDKGLVFQKDDGFDNLYYVTREDEDLHRKIHRIIQQDLQKPNHMAEGAVTSWKSWACARLDIPPGLSEVLLEPKVLEDPGREPQWPMVRTTGGLIITKLSSKRTRRTTLWGDHHTKRGRYNPPGGQTYTPLITGGDHTSEAQTPTTEVSNYILGHERGNTGWALIAKNSAEERRIQAEQQNTPAPPDAGHNNETARVRILRNHS

SEQ ID NO: 791379 - protein, 208 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATAYYKVDDPVWNIQIARMLELPTIYRTKIRWHSPPGSDFQHHAGAYLSGGSYLIINYKI

SEQ ID NO: 791380 - protein, 460 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQYREEREIHATAYYKVDDPVWNIQIARMLELPTIYRKVYDQPFHSSALEKEEALSNPGALDLPSLTSLLSEKAKEFLMENRVQSFYQQELEMVESLLSLANQPVIHSACSDQVNFKKDTTSKAIHSIFKNAIQLLQDKGLVFQKDDGFDNLYYVTREDEDLHRKIHRIIQQDLQKPNHMAEGAVTSWKSWACARLRHSARAEEVLLEPKVLEDPGREPQWPMVRTTGGLIITKLSSKRTRRTTLWGDHHTKRGRYNPPGGQTYTPLITGGDHTSEAQTPTTEVSNYILGHERGNTGWALIAKNSAEERRIQAEQQNTPAPPDAGHNNETARVRILRNHS

SEQ ID NO: 791381 - protein, 120 aa, Homo sapiens
VKGCFTDFHIDFGGTSVGTMFSGVEDFLADSSNAAQLALYEEWVLSGKQSDIFLGDRVERCQRIELKQGYTFFIPSGWIHAVYTPVDSLVFGGNILHSFNVPMQLRIYEIEDRTREKNKL

SEQ ID NO: 791382 - protein, 120 aa, Homo sapiens; identical to SEQ ID NO: 791381

SEQ ID NO: 791383 - protein, 110 aa, Homo sapiens
GTALELEEAQEPSCHCPGLAQAESVAGARGGREGVTSTAPTASHTAPSPGHSGSYGGRDQGVQPGLLCLTGEGLLSFSRAAALLLKSLLLLLLGVFACLQEVLESKKRSL

SEQ ID NO: 791384 - protein, 109 aa, Homo sapiens
MTRNCSAKGLGWGFGVIIHINHEVWLWFEVQSMHWLLSLTGRASLPLAPKSTAAAGLMPQGRREPAAPLPPLPPSCQPFTPPARFRIRTYEQSVSFFFFLCLCLSFSFD

SEQ ID NO: 791385 - protein, 120 aa, Homo sapiens
LSSPSQILAACPGTHCETCPSVTPEVGLNISISVVDLEAALQLGFCPSQLQTGAVLPVQSLTQWSSKSLPGDLEESYPFTTGQQAYSCAPEVDHQPSTSPLDQVVETVETTLGPDRIHAC

SEQ ID NO: 791386 - protein, 396 aa, Homo sapiens
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 791387 - protein, 71 aa, Homo sapiens
QMRGRSKDGGCGSPCGGALCTPAPPWRIMGNRKGTHCGRFFGMDPRVLTAFLSGSWGSSELMPSLVHRLFM

SEQ ID NO: 791388 - protein, 93 aa, Homo sapiens
QQAARGEPGSARGQLQVSPEMSITHKEKENAHLKEILLFVNAEAFSQPQPHSAPVCEGQQLTGKFSTSVLTRAGGDASPCSWERLLCYGWSHC

SEQ ID NO: 791389 - protein, 112 aa, Homo sapiens
SPASSERGAEPFLMDTGSREAAFTRDLPRKPADAQVSPEMSITHKEKENAHLKEILLFVNAEAFSQPQPHSAPVCEGQQLTGKFSTSVLTRAGGDASPCSWERLLCYGWSHC

SEQ ID NO: 791390 - protein, 178 aa, Homo sapiens
APPDFLQVPYDPALGSPSRLFHPWTADMPAHSPGALPPPHPSLGLTPQKTHLQPSFGAAHELPLTPPADPSYPYEFSPVKMLPSSMAALPASCAPAYVPYAAQAALPPGYSNLLPPPPPPPPPPTCRQLSPNPAPDDLPWWSIPQAGAGPGASGVPGSGLSGACAGAPHAPRFPASAA

SEQ ID NO: 791391 - protein, 71 aa, Homo sapiens
PLSARRSAASNPEVITHQEGIIPGTAGSASLLGFRSQKPIRQLNSNNDPPLNTLREEHDEEFVQEEARSTC

SEQ ID NO: 791392 - protein, 99 aa, Homo sapiens
KNECFHVLHPQNFWFFLLEPKEQGQNEEHDVSYRQLLMTSPSRTEGGILLHLGLGASFSIQYWGSSSSIQDLGVILLHPGPEGCPFLRFLGWQSFPSCL

SEQ ID NO: 791393 - protein, 65 aa, Homo sapiens
PGEHRKLYLAEMSHVGKHKMHNPSNFHHLPQFTTMGVINHTQTQLMLQFFIQFQITSFHDFTVKL

SEQ ID NO: 791394 - protein, 81 aa, Homo sapiens
MVFLNYKCTTPLILLLPSQIPRSYKQDWLLYCSKLISLAYHAFLIFMPSLMMFSLLEIYHILLPQLLLQVNFLLKAEPDQI

SEQ ID NO: 791395 - protein, 230 aa, Homo sapiens
IPGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPTLHGPEILDVPSPVQKTPFVTHPGYDTGNGIQLPGTSGQQPSVGQQMIFEEHGFRRTTPPTTATPIRHRPRPYPPNVGQEALSQDNHLMGPIPGHF

SEQ ID NO: 791396 - protein, 236 aa, Homo sapiens
IPGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQDNHLMGPIPGHF

SEQ ID NO: 791397 - protein, 170 aa, Homo sapiens
IPGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTRTRSSLSRQPSHGPHSRTLLSTSFHVILLALMKNPYSSGFLELLPVPL

SEQ ID NO: 791398 - protein, 102 aa, Homo sapiens
SGEEDRKGCGLMKLTFRQTTHNSDDWKVQDHGTGICSASGEGHVLCQDMVETWKGALPSCWNSWCVSDIIVRLGEGNPGLYKMSGEKMALSNWPLHRDQPAS

SEQ ID NO: 791399 - protein, 128 aa, Homo sapiens
LCSFRTWVLKWSFEGWLRGLHSIPPTVPSAPPPSPHEPVRTYHTYGGPWSHPSFQVFPERVDAALGQEGLFPSLLSFCSSAWFWLAFAGVERLKCAKKGVLAITVVVPVSPAAPVPQQLTDNRGLEGV

SEQ ID NO: 791400 - protein, 135 aa, Homo sapiens
AGEAGARAPPASGAPAGDGGAGDVPVLSGPGSSMHPDATDSGGAGLSPARAAGAGGRPVSGFRGERRPESPGDAEAAAAAPGAPGGRSWWKPVAVAALATVALSFLGPGSGEAAGAAGLSSVLLRLSLYLSCAAA

SEQ ID NO: 791401 - protein, 528 aa, Homo sapiens
PLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPG

SEQ ID NO: 791402 - protein, 75 aa, Homo sapiens
MAPEVLPKPRMRGLLARRLRNHMAVAFVLSLGVAALYKFRVADQRKKAYADFYRNYDVMKDFEEMRKAGIFQSVK

SEQ ID NO: 791403 - protein, 83 aa, Homo sapiens
SPGLGIRPRRHGCEKDDRRGTARFVFPLVRKDVGVEVSIRIKDSNYHGSRSFAKTSDAWPSGQASAKSYGCSIRAIPGGCSFV

SEQ ID NO: 791404 - protein, 104 aa, Homo sapiens
GHNGTLPLSLCLGFSRDLCVSAVVQLQASPASTLSRFRCGLREGGGRTTDRKDVGVEVSIRIKDSNYHGSRSFAKTSDAWPSGQASAKSYGCSIRAIPGGCSFV

SEQ ID NO: 791405 - protein, 70 aa, Homo sapiens
ILLLRAATARFVFPLVRKDVGVEVSIRIKDSNYHGSRSFAKTSDAWPSGQASAKSYGCSIRAIPGGCSFV

SEQ ID NO: 791406 - protein, 75 aa, Homo sapiens; identical to SEQ ID NO: 791402

SEQ ID NO: 791407 - protein, 75 aa, Homo sapiens; identical to SEQ ID NO: 791402

SEQ ID NO: 791408 - protein, 77 aa, Homo sapiens
MTDAAVSFAKDFLAGGVAAAISKTAVAPIERVKLLLQVQHASKQITADKQYKGFIDWVGRFQGARRFVLLRGNLANV

SEQ ID NO: 791409 - protein, 75 aa, Homo sapiens; identical to SEQ ID NO: 791402

SEQ ID NO: 791410 - protein, 75 aa, Homo sapiens; identical to SEQ ID NO: 791402

SEQ ID NO: 791411 - protein, 75 aa, Homo sapiens; identical to SEQ ID NO: 791402

SEQ ID NO: 791412 - protein, 102 aa, Homo sapiens
RAGGGVEIVCQRTLVLRLAYVSRTVTTMAPEVLPKPRMRGLLARRLRNHMAVAFVLSLGVAALYKFRVADQRKKAYADFYRNYDVMKDFEEMRKAGIFQSVK

SEQ ID NO: 791413 - protein, 91 aa, Homo sapiens
LGLCRTTVKSFLGITTMAPEVLPKPRMRGLLARRLRNHMAVAFVLSLGVAALYKFRVADQRKKAYADFYRNYDVMKDFEEMRKAGIFQSVK

SEQ ID NO: 791414 - protein, 70 aa, Homo sapiens; identical to SEQ ID NO: 791405

SEQ ID NO: 791415 - protein, 75 aa, Homo sapiens; identical to SEQ ID NO: 791402

SEQ ID NO: 791416 - protein, 75 aa, Homo sapiens; identical to SEQ ID NO: 791402

SEQ ID NO: 791417 - protein, 75 aa, Homo sapiens; identical to SEQ ID NO: 791402

SEQ ID NO: 791418 - protein, 75 aa, Homo sapiens; identical to SEQ ID NO: 791402

SEQ ID NO: 791419 - protein, 75 aa, Homo sapiens; identical to SEQ ID NO: 791402

SEQ ID NO: 791420 - protein, 970 aa, Homo sapiens
TVLVLRFCASLMEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 791421 - protein, 959 aa, Homo sapiens
TVLVLRFCASLMEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 791422 - protein, 752 aa, Homo sapiens
TVLVLRFCASLMEMKLPGQEGFEASSAPRNIPSGELDSNPDPGTGPSPDGPSDTESKELGVPKDPLLFIQLNELLGWPQALEWRETGSSSASLLLDMGEMPSITLSTHLHHRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWPQRPVLLVRYFTRFTEEGFCALSYLLT

SEQ ID NO: 791423 - protein, 994 aa, Homo sapiens
TVLVLRFCASLMEMKLPGQEGFEASSAPRNIPSGELDSNPDPGTGPSPDGPSDTESKELGVPKDPLLFIQLNELLGWPQALEWRETGSSSASLLLDMGEMPSITLSTHLHHRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 791424 - protein, 970 aa, Homo sapiens; identical to SEQ ID NO: 791420

SEQ ID NO: 791425 - protein, 994 aa, Homo sapiens; identical to SEQ ID NO: 791423

SEQ ID NO: 791426 - protein, 120 aa, Homo sapiens
SSGPSCLAFRSASARGSPSWDLLAGAAAFQGNCPCPWGTASVRGDTCGPSPLPAWRKGRGGPPYVTSGCSAARAHSGAAGAAWTPDARAVQSGDSEAEPVGGRPGGHGRPRPAFCWATEL

SEQ ID NO: 791427 - protein, 151 aa, Homo sapiens
WTWTVAWALESWPFPDLLSQRQHPNPRDPRDACAQSLREAPGRLFAVTRRSPRMPVRSHLEKSQDACAQSLGEAPGPLCTVTRRSPKLTQLCRNDCCKQILEVARGLCLQCYSQDGCVVWQRDSEGMVKFTNPLTLKQGGASGPDLITPTL

SEQ ID NO: 791428 - protein, 146 aa, Homo sapiens
RLGTEAWVWVRWKMRRSLRAGKRRQTAGRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791429 - protein, 146 aa, Homo sapiens; identical to SEQ ID NO: 791428

SEQ ID NO: 791430 - protein, 146 aa, Homo sapiens; identical to SEQ ID NO: 791428

SEQ ID NO: 791431 - protein, 152 aa, Homo sapiens
MEDEEVAESWEEAADSGEIDRRLEKKLKITQKESRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791432 - protein, 236 aa, Homo sapiens
ACADQGGMSGFAGKREEAAEGGGKLILFGLLNSAKIPHHPSRWTSRVFFLFHFYSKKSLWAGRQVSRGLCQSNRKLCGAAPLPLSDPRPREGLGVRLSESREIDRRLEKKLKITQKESRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791433 - protein, 156 aa, Homo sapiens
MGRIREGEESDERWVWDMDRASLVRSMICEAVFAALSARKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791434 - protein, 146 aa, Homo sapiens; identical to SEQ ID NO: 791428

SEQ ID NO: 791435 - protein, 146 aa, Homo sapiens; identical to SEQ ID NO: 791428

SEQ ID NO: 791436 - protein, 152 aa, Homo sapiens
QARGGGGGGGKAASKIRWKMRRSLRAGKRRQTAGRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791437 - protein, 146 aa, Homo sapiens; identical to SEQ ID NO: 791428

SEQ ID NO: 791438 - protein, 152 aa, Homo sapiens; identical to SEQ ID NO: 791431

SEQ ID NO: 791439 - protein, 89 aa, Homo sapiens
QARGGGGGGGKAASKIRWKMRRSLRAGKRRQTAGRKSKSPPKVPIVIQDDSLPAGPPPQIRILKRPTSNGVVSSPNSTSRPTLPVKSPW

SEQ ID NO: 791440 - protein, 152 aa, Homo sapiens; identical to SEQ ID NO: 791436

SEQ ID NO: 791441 - protein, 133 aa, Homo sapiens
MRRSLRAGKRRQTAGRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791442 - protein, 146 aa, Homo sapiens; identical to SEQ ID NO: 791428

SEQ ID NO: 791443 - protein, 187 aa, Homo sapiens
RLGYRGLGVGKMEDEEVAESWEEAADSGGWCEQKMNVWEKNVDSHNTLYRYKEIDRRLEKKLKITQKESRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLGPDGSQGFKQRR

SEQ ID NO: 791444 - protein, 146 aa, Homo sapiens; identical to SEQ ID NO: 791428

SEQ ID NO: 791445 - protein, 157 aa, Homo sapiens
MEDEEVAESWEEAADSGEIDRRLEKKLKITQKESRKSKSPPKVPIVIQDDSLPAGPPPQIRILKRPTSNGVVSSPNSTSRPTLPVKSLAQREAEYAEARKRILGSASPEEEQEKPILDSIDKGCPKSMERERVGVRGRLGGPSKDSESQTVPLGHLG

SEQ ID NO: 791446 - protein, 146 aa, Homo sapiens; identical to SEQ ID NO: 791428

SEQ ID NO: 791447 - protein, 180 aa, Homo sapiens
RLGTEAWVWVRWKMRRSLRAGKRRQTAGRKSKSPPKVPIVIQDDSLPAGPPPQIRILKRPTSNGVVSSPNSTSRPTLPVKSLAQREAEYAEARKRILGSASPEEEQEKPILDRPTRISQPEDSRQPNNVIRQPLVSRDSRNLWGPVFWSCDPRGAHGPLGCLNRRAWEGGLHPCSLTLLV

SEQ ID NO: 791448 - protein, 256 aa, Homo sapiens [sequence omitted]

SEQ ID NO: 791449 - protein, 659 aa, Homo sapiens
MAPLHSRLDDKVRHCFQKRRRKEEEEGEERKKENEEGEGEGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKATEQLVNDILRQALAVGYQTASHNRIPKEITVSNIHQAICNIPFLDFLTNKHMGILNEDQ

SEQ ID NO: 791450 - protein, 1433 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKAQRSCN

SEQ ID NO: 791451 - protein, 1487 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKATEQLVNDILRQALAVGYQTASHNRIPKEITVSNIHQAICNIPFLDFLTNKHMGILNEDQ

SEQ ID NO: 791452 - protein, 1487 aa, Homo sapiens; identical to SEQ ID NO: 791451

SEQ ID NO: 791453 - protein, 1487 aa, Homo sapiens; identical to SEQ ID NO: 791451

SEQ ID NO: 791454 - protein, 1487 aa, Homo sapiens; identical to SEQ ID NO: 791451

SEQ ID NO: 791455 - protein, 1310 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCIAVSWVTELIVSC

SEQ ID NO: 791456 - protein, 1098 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSD

SEQ ID NO: 791457 - protein, 627 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKVTFLLRYYTC

SEQ ID NO: 791458 - protein, 718 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVCVG

SEQ ID NO: 791459 - protein, 1487 aa, Homo sapiens; identical to SEQ ID NO: 791451

SEQ ID NO: 791460 - protein, 144 aa, Homo sapiens
MGEQSEGMAPVSSSTVSSVTKTSGQQQVCVSQATVGTCKAATPTVVSATSLVPTPNPISGKATVSGELHCDIISLSFLSLGWNIFVCLFEIASHSVAQARVQYHNLDSLQPLPSRLKPSSHLSLLIIRDHRHMSPHPANFLCFW

SEQ ID NO: 791461 - protein, 913 aa, Homo sapiens
SPPTPSCTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKATEQLVNDILRQALAVGYQTASHNRIPKEITVSNIHQAICNIPFLDFLTNKHMGILNEDQ

SEQ ID NO: 791462 - protein, 106 aa, Homo sapiens
MPVPRSSEISLCPQAEAPSMGGSGRQEKVALPGARVYWRRPISDFLTQPVWKAEQRMHAQSEICSILLQENRKPVSQSQRNLPKQRNSCFHGSCRCLSQEGKAGSD

SEQ ID NO: 791463 - protein, 106 aa, Homo sapiens; identical to SEQ ID NO: 791462

SEQ ID NO: 791464 - protein, 606 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDNQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQSSPGDRGDPVSKID

SEQ ID NO: 791465 - protein, 1244 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSKTITLNIGVHF

SEQ ID NO: 791466 - protein, 1176 aa, Homo sapiens
AGRNAPGGLHRAVCFRRLRGSLGPCGGAAPRGFARSLTSPCSLAAAGGARAAAGDPEKGEELNVIMSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGELHCDIISLSFLSLGWNIFVCLFEIASHSVAQARVQYHNLDSLQPLPSRLKPSSHLSLLIIRDHRHMSPHPANFLCFW

SEQ ID NO: 791467 - protein, 97 aa, Homo sapiens
THRPQQSQAGDAIPTPHLGVAPAPIPTDLLGFASSREPQVSSATHRFAERSGHQGLSRATHLACQDVQSFQNDSVDCWGLFSAQDQVRPSLEVAARQ

SEQ ID NO: 791468 - protein, 80 aa, Homo sapiens
MPVPSSMLQILTPNCLLGSHTELYNVHRKLPLSETEHNVPCSSPVVIFPMSGDGTTIHSGAQVKILNSSLTHPPPIQWRP

SEQ ID NO: 791469 - protein, 152 aa, Homo sapiens
GGPDAPLGTLCGPRGPGPATPAAPGGPRLPQDALAAGPRRCRLLRVPDGLLSRALRAGRSRRLARVRSVSSGNEDEERRAGSESPARAPSSSPLSSRAPLPERLEARAVALGRAGRLAWLLSTVREPASPPPAAPRGEPVRRRPRARAVRCR

SEQ ID NO: 791470 - protein, 298 aa, Homo sapiens
SAFGHVRERTFHLSFNMGKGNEDPDLHCSSIQCSTDQPPFQQISFTEKGSDEKKPFKGKGKTAFSHSSEKHTQRQAGSDPNPNKENSEETKLKAGNSTAGSEPESSSYQENCRKRKISSKDICQDRAGNCPEEECNLTLNKKSRSSTAVHNSEIQETCDAHHRGSSRACTGRSKRHRSRALEVQTPSLRKSLVTSVRAMSEAVYQDLAQVWAQQIHSPLTCEQLTLLTRLRGPLCAQVQTLYSMATQAAYVFPAESWLVPATLPGPGDSALDREAHPFPGQEITEPVSGSDEAKLGAP

SEQ ID NO: 791471 - protein, 111 aa, Homo sapiens
DGVLLLLPRLECNGAILAYRSLCLLGSRDSPASAFLSSWDYRHAPPHPANFVFLVETGFLHVGQADLELPTSDDRPASASQSAGITGVSHRSRPPVNCYYEVDGDYILLLS

SEQ ID NO: 791472 - protein, 113 aa, Homo sapiens
RSAEIYTSLNYECSKPTTAVLPVYKILSLIETYIYYYYYYYYTLSSGIHAQNVQFCYIGIHVVWWFAAPINPSSTLGISPNAIPPLAPPRQVPVCDVPFPVSMCSHCLAPTYE

SEQ ID NO: 791473 - protein, 117 aa, Homo sapiens
EGREIVPGLLKDAASEMNIEDWGGFKQVETDGMDTGLGSSASPTSAEEHRKFCSTGFLCSSTYASSFSLVACRAWLALRPEVLKSAGILHLCNLLLSPSHHRNQSLEAFGLGAAFTV

SEQ ID NO: 791474 - protein, 92 aa, Homo sapiens
QEESWREDMHPLKTQREAVCLPRSSYIRLRHFLFTGDYKIPAPCSFGADAILGLSPSAPRRSLKQCVAPHRLVLLVGALSGFRPIQEPCRKH

SEQ ID NO: 791475 - protein, 123 aa, Homo sapiens
DLRGFPCIFVFLFSGRLASVTVWCSRAHSSIRGLATSSEKPSYMIPLKLHFLLSAPIMGIARLPSAFGNAKTIRNDNSSRFGKYIDIYFNPSGVIEGARIEQFLLEKSRVCRQVRPPPSQVGS

SEQ ID NO: 791476 - protein, 107 aa, Homo sapiens
IAQSISFRSCLPSAADTSVQISGLSGDAGLFEENQPNEIKSWGWGEAEQTQDLVAHRRCYRVSFLFRILYSAHVIYLSIYITITTRRVDTRCHTLQESINKVQYFQI

SEQ ID NO: 791477 - protein, 204 aa, Homo sapiens
EGGDPEDLKLTDDEEPPNMASESGKLWGGRFVGAVDPIMEKFNASIAYDRHLWEVDVQGSKAYSRGLEKAGLLTKAEMDQILHGLDKVAEELGPGTFKLNSNDEDIHTANERRLKELIGATAGKLHTGRSRNDQVVTDLRLWMRQTCSTLSGLLWELIRTMVDRAEPNVMSLSGDPIGEGQPFRGATDFEPRRGLTRGALKAPC

SEQ ID NO: 791478 - protein, 393 aa, Homo sapiens
EGGDPEDLKLTDDEEPPNMASESGKLWGGRFVGAVDPIMEKFNASIAYDRHLWEVDVQGSKAYSRGLEKAGLLTKAEMDQILHGLDKVAEELGPGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVGEFLFWASLCMTHLSRMGEDLILYLTKEFSSCSLRCLQQGSKLMPQKKKPEGGADPEPGWACVGGGAGLIAPGTPDLTQDFGGRPVRAHGRPGHGAQRIQNGSHQGGGLRRGPAAEVAGAPGGTRRGRVAEGTQRE

SEQ ID NO: 791479 - protein, 106 aa, Homo sapiens [sequence omitted]

SEQ ID NO: 791480 - protein, 100 aa, Homo sapiens
MRQYLQAWQHEVYVYTPCSFLQGTTIAEAFVALSAKLPSNLALDGSLADLIKKVPSLSIFSIYLSTYLSIYLFPFSYPPIQAGPGGLQHQGGKGGGLLNF

SEQ ID NO: 791481 - protein, 95 aa, Homo sapiens
IQTPREGSWISRKKEFRGTTIAEAFVALSAKLPSNLALDGSLADLIKKLPVQTSINAGSTSKHCGDMSVPPSRPSILNSGCSLDIPEELSKETSA

SEQ ID NO: 791482 - protein, 151 aa, Homo sapiens
MQASPTASRLRRTEPPPLLLGLRSIPLPISWRISVVWAGNLYPVIRQKTMKGGPLDRRLYGRKQSPPQGAGRPLGTRPAGHSAEAGHAWSLQVLPALPQPFYDTHPAARKGFRRETAWGPEGARPSFTLWTTSDLPRSHIYNSTFQKVEES

SEQ ID NO: 791483 - protein, 126 aa, Homo sapiens
QCDQEELKRGLSIPATAAPFSLGCRHPDRKGVLTTPQGLAPPCAAKLATPSAWHAHPRHPHHWLPIVPWVLSVRKPHKSSCLSSTVGLLHRTFSSFPGIYIILEPFYLRVHLSNHTAMVLKYVLNS

SEQ ID NO: 791484 - protein, 35 aa, Homo sapiens
MDRLECPGVDLPGGHKGYIQLNAAEIILIKVFNVL

SEQ ID NO: 791485 - protein, 101 aa, Homo sapiens
GGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFL

SEQ ID NO: 791486 - protein, 139 aa, Homo sapiens
MHYINRLRDNHMIISINAKEVFDKVQHTFLIKSPSTLCIEGKFLNIIKDIYGKHTANIIINEEKLEVFHLRSTVQGCSFSPLPFNIVLEVLARAIRQEKEIKGLQIRNEEVKLSVFADYIILYIDNPKDSAKKLLCIIN

SEQ ID NO: 791487 - protein, 98 aa, Homo sapiens
RDYYIETTYIDIESLDTKHLTNRPNLSTLPFFHSASEQRGSTPLWAAGQLSESTDLEQAQEGKGGEEGRADTQDSTAGINRSRRATQDTVKGLKSLFW

SEQ ID NO: 791488 - protein, 148 aa, Homo sapiens
CPPSPGCGAGRRALATPGPLESPAAAQDPLPRHVGPSGLGWSLEPAARVLSGLLVGAGVGPRLPCGARWFHAPERPRCADLAALRGDGSALKTVVFPKPSLLSGLQGAAGEGFVPVAKALQVEPYLLWEGPAFSDSRRALCRLLAEKR

SEQ ID NO: 791489 - protein, 754 aa, Homo sapiens
SPEDPRRPESRLRPEVAHQLFRCFQYQEDMGPRASLSRLRELCGHWLRPALHTKKQILELLVLEQFLSVLPPHLLGRLQGQPLRDGEEVVLLLEGIHREPSHAGPLDFSCNAGKSCPRADVTLEEKGCASQVPSHSPKKELPAEEPSVLGPSDEPPRPQPRAAQPAEPGQWRLPPSSKQPLSPGPQKTFQALQESSPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 791490 - protein, 89 aa, Homo sapiens
MWLCLEASKRALMCKVQPHLCPQLQDGLAHIPHPGFSSQAVPHPPSVWPLPRNVGPRLQTPTWPGFFHRTCPIQLHPSKEPQSRQTLLP

SEQ ID NO: 791491 - protein, 81 aa, Homo sapiens
AHCGSVGQLGCLRSSCLLSSLDLARNALMGMAEAKMVGRRTITKNAEWGAGLSVGPLLKQTFLQPPGHHPCHLYCQRHRVP

SEQ ID NO: 791492 - protein, 318 aa, Homo sapiens
SAVSGSRGRRHRCGCLSYCRSRRGIRRVEPLRRARARVGPRFRPLCRMEIIRSNFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFL

SEQ ID NO: 791493 - protein, 267 aa, Homo sapiens
SAVSGSRGRRHRCGCLSYCRSRRGIRRVEPLRRARARVGPRFRPLCRMEIIRSNFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWK

SEQ ID NO: 791494 - protein, 290 aa, Homo sapiens
ARFPEVAAGVTAAAASATAAVAAEFDFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFL

SEQ ID NO: 791495 - protein, 114 aa, Homo sapiens
GATRDLPGPLGKLATHQAQSQKNAVPTRRQNKYSNPNNGHQITQQVLISTPPALSPSPDGTLVLCPALALDNPISPLTLEQGKEHTPPPPAERMASSSKPLFLILTLEMGGWPG

SEQ ID NO: 791496 - protein, 102 aa, Homo sapiens
MPALSFPSVTHFYWLREKLQPPGEVLGQVPRLLAGVVSGFPLMICKVTWGPQLPPTKLLHLLYHFQIRSPLQHLDTPGQHEPEAHALQPERVQRARVRRGRP

SEQ ID NO: 791497 - protein, 67 aa, Homo sapiens
LQLNANQAFFLLVNGHSMVSVSTPISEVYESEKDEDGFLYMVCASQETFGMKLSVLNQKKCISSRIF

SEQ ID NO: 791498 - protein, 79 aa, Homo sapiens
MRPVALLLLPSLLALLAHGLSLEAPTVGKGQAPGIEETDGELTAAPTPEQPERGVHFVTTAPTLKLLNHHPLLEEFLQE

SEQ ID NO: 791499 - protein, 89 aa, Homo sapiens
YVQHNKSATYSVGMQKTYSMICLAIDDDDKTDKTKKISKKLSFLSWGTNKNRQKSASTLCLPSVGAARPQVKKKLPSPFSLLNSDSSWY

SEQ ID NO: 791500 - protein, 68 aa, Homo sapiens
MAVIPVLWEAEVGDHEVKRSRPSWPTWGNPMSTKNTKISWAWWHMPVVPATQGAEAGEWREPGRLRLQ

SEQ ID NO: 791501 - protein, 99 aa, Homo sapiens
RSAQALCGQPGHSIRAPLSFRRSPPWAVLQGCGLGHDGPQLRSSSPFPAGWWAAPSGDLGSEGTPPGTTRCLHLSRDAAGPRVTDCNPRTTLGSLSPRP

SEQ ID NO: 791502 - protein, 71 aa, Homo sapiens
RGIGTYYVADSDCEEELSQVKSGRQVPCDREEVDLKGAGIVALLKPSLLRKAKAKQQEVATEAVWSLEVEG

SEQ ID NO: 791503 - protein, 105 aa, Homo sapiens
MRRQFDYEIHPKTYNFRVFAWIAEDGFLQNVSTTVIVRVWDENDNSPTFLHDVLFLKVEESPVPQGVIGKITAIDMDSGKNGQLLYFLLSDGKFFKMNPNTGSTS

SEQ ID NO: 791504 - protein, 1075 aa, Homo sapiens
QRTEKGHLRGKFPDGCQQSATSLWLCTLSTRFYRAYHILVHKRTSPRSTLAPSYETGFIIRILYEGNLTVERELSCSRRHSRAHRWQNPTRARFDPRGGNHGRPPGCASRAELRSESSPPCGHRPAPTPAPARSSLAASSPRPPRSWWRRGGRRRREGGRWHRERPSAGRERGERDTCGPEHRGHPVPAGPGPRPLAGDTWKNTEFYTRVDLLMAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 791505 - protein, 309 aa, Homo sapiens
PTLKAISFNTCLSSFIFLSEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 791506 - protein, 80 aa, Homo sapiens
FGSAVNPGAVIDSFSTKIIFKLLQARCSISRLESQNFRRLRWEDCLSPGVQESETNLGNTVKPKFYKKYKKSGWHGCVHL

SEQ ID NO: 791507 - protein, 118 aa, Homo sapiens
GRNAPGKGHNETGFIRTACLREIKQGTGHQVCPWAPAAADRVLGAEDTRLGESNWKKCKALQRRPIKSSLFCSFFSCFCILGILLNWGETKMPRSQILQLSSSKMSNERTKVCWILYC

SEQ ID NO: 791508 - protein, 118 aa, Homo sapiens; identical to SEQ ID NO: 791507

SEQ ID NO: 791509 - protein, 156 aa, Homo sapiens
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGPVSLTMCKLTSGKYPNCRYKEKRQNKSYVVACKPPQKKDSQQFHLVPVHLDRVL

SEQ ID NO: 791510 - protein, 60 aa, Homo sapiens
QEGKGCGCSCCSCCDPCSHCSCHNHISTGRASGSARAEEGGGKKKKKKKDKKHKKDKKHK

SEQ ID NO: 791511 - protein, 131 aa, Homo sapiens
HRGHTPSVRTTSKAGPPSHTVLAETETGDQEPGPTLACSLGGCWGCGGPLGCWLGLGEPLKVHGDRDSFSSVCFLADSKLLPLEALAQDGEASAGQVPRPCPPLMGLTLRRWHPAGHTMALAPCLTHTWWQ

SEQ ID NO: 791512 - protein, 71 aa, Homo sapiens
AAAFGHQNSRFSHVEPRHPSSAAFGHQNSRFSGLCTLGCVAATPAPGFQAFGLRLQATPLASLVLRLLDLD

SEQ ID NO: 791513 - protein, 122 aa, Homo sapiens
RGSVAPLAVVVGSNGEIAARLERIHQQLLKHIRKLSKNPQNTNSEGTSTGTPDEAAPLAGRTPDTAESLVEKTPDEAAPLVEGTSDKIQCLGKATSGKFEQSAEEYVRPCVSITAIELCIVQ

SEQ ID NO: 791514 - protein, 181 aa, Homo sapiens
MDSGCIGSAVLLMAASHTLGPVPGTQQALDSRKPSHARGGPRLSGWERAEPLSGSWLLLLRTPLAFSSLPILSPSQPGLRTRLFPPFRITLPDTIYVFKKQTHLLNKRMKQWMRRGGNQAGWHRHQYMWWLLEGGRARAAAGHSPGPCPPSSQGLSGLLQWVPKGPSLPWASGHLDPQPTC

SEQ ID NO: 791515 - protein, 110 aa, Homo sapiens
YKRSLSSWVFFVFFILEIHNTPNALRTMDSTQVLQMSSPGFRRKVVDILSIMTQTNNYIPGFVGEKARWPTWRFMPKQPLYNTTHGVLDVGLVCQSHHLIPFRNLSAISR

SEQ ID NO: 791516 - protein, 179 aa, Homo sapiens
IVCPPAGWSPDPKYQICLCFGEEDPGPTQHPKEQLIMADVQVQLRPGSSSCTLSASTERPDGSSTPGNPDGILTFNAAASILSEPLPLLVPAEGSPQQGGSLLPPNPAHTKPIDLGPPPAHHPGLPDGRGGSRPSTPLSRAPSWAWGFGRKLNLILRPQKGSNWSRSKTSSLADSPICQ

SEQ ID NO: 791517 - protein, 55 aa, Homo sapiens
VPDCIQRRHKTAATPVWLLFYGGVGICTGLWVWGRRVIQTMGKDLTPITPSREAW

SEQ ID NO: 791518 - protein, 123 aa, Homo sapiens
MAAAAVQGERSGGSGGCSGAGGASNCGTGSGRSGLLDKWKIDDKPVKIDKWDGSAVKNSLDDSAKKVLLDTISCFFAIVALIWDYMHPFPESKPVLALCVISYFVMMGILTIYTSYKEKSIFL

SEQ ID NO: 791519 - protein, 100 aa, Homo sapiens
ILLSPAEHRGDEEFSSEQRAQGMQPSRECMLPTSKLTGLKDSHRSSLPKSQGSVRLLELDSSSRAAAPPVPMLTHLRCSWYQPEFENWKAGGLGPSPVLP

SEQ ID NO: 791520 - protein, 136 aa, Homo sapiens
GFRIVHKFEGSRRLTPMLEEVLLWVKCYQTAFHTTEKPGMKGRVNQCDKLHCCLILRNCSQAWRLMPVISASRVAGITGTCHHAQLIFVFLVETGFHHVGQAGLELLTSSYPPALASQSVGIIGVSHRTQPSCELF

SEQ ID NO: 791521 - protein, 157 aa, Homo sapiens
LKHPLSSQTARGSSGPSPWVGKKLRGCESPGRPLLLNLAELGERSKFQREPVCTGEEAELVRSSHTATATADVPTPQPLPLHPRASGARPETFAPSSEDRPLRPCGPRPASLRWRFLGAGPTEGVGGAESGHQRAARDFPVCFRSGSHQTNTPISQA

SEQ ID NO: 791522 - protein, 104 aa, Homo sapiens
MSMEFTQITSRNLWNKKFTTPWPHTKMLGCRKPEAESSIITVKSPPSADPTNSHSASHHLKKTHVSNYYTSSEYWKMVHSSYVLICLSCVQSVLSFQATLFLVY

SEQ ID NO: 791523 - protein, 147 aa, Homo sapiens
MHGSRDQPVLPSQRPLHPTGCAPWNVVVALGAATRGRGRTVFGADHGQAAPHQAASCWCHQSLGYPLLKPSLVSTCPTPLPCPSYFLPGYLLTSCPGHQSFTCGHAPFPDNPFFILHFSTTPSSPSTPSCSTLSPLLHTQPPAPPPF

SEQ ID NO: 791524 - protein, 150 aa, Homo sapiens
MHGSRDQPVLPSQRPLHPTGCAPWNVVVALGAATRGRGRTVFGADHGQAAPHQAASCWCHQSLGYPLLKPSLVSTCPTPLPCPSYFLPGYLLTSCPGHQSFTCGHAPFPDNPFFILHFSTTPTPPPLPAPPHSTPSTPTTPSCSTLNPQL

SEQ ID NO: 791525 - protein, 143 aa, Homo sapiens
CFRFWPATSQVPPLPGERCLNSSPRQALLVNVLLLRKKHFIKPPTRRALSAPLGYSGPSVTLHVLNRGWFCFGIWKIRKVKKQTKKQLSGRHAPKIVYSAPTFVSPRVRRGGKKKGGNCPCAVSRCPPSPAAPGSAAVRWGWG

SEQ ID NO: 791526 - protein, 131 aa, Homo sapiens
MDFHRQRKDPALGAESHLPAGPSKLWSLGGQGREPTPSSVHGSGSWPEPACVEATPAAPSPAQLCPHSCKASILPFVKFTTVMSHPPFAEISPKLPGNPDPAPPPQLSFFMEFLFQNKETDTPKTIKEINL

SEQ ID NO: 791527 - protein, 111 aa, Homo sapiens
QPGPPRSLATLSPAEPSPLLQAPAPLLSSPGLSHPHCLAEPMSSRFLDTKSCVSKHGAKEDGLAQNHPENQAQRQLKGQKHSGPPQQHMNVNISLRIYPNSGNTNVRKCSL

SEQ ID NO: 791528 - protein, 456 aa, Homo sapiens
MDTVVFEDVVVDFTLEEWALLNPAQRKLYRDVMLETFKHLASVDNEAQLKASGSISQQDTSGEKLSLKQKIEKFTRKNIWASLLGKNWEEHSVKDKHNTKERHLSRNPRVERPCKSSKGNKRGRTFRKTRNCNRHLRKNCCTSVRRYECSQCGKLFTHSSSLIRHKRAHSGQKLYKCKECGKAFSRPSYLQTHEKTHSGEKPYACQSCGKTFLRSHSLTEHVRTHTGEKPYECGQCGKGFSCPKSFRAHVMMHAGGRPYECKHCGKAFRCQKSFRVHMIMHAGGRPYECKQCGKAYCWATSFQRHVRIHNGEKPYKCGKCGKAFGWPSSLHKHARTHAKKKPVSGGSVGKSSARPRPSTDVKSQTREKVYKCETCGKTYGWSSSLHKHERKHTGEKPVNAASVGKPSGGLCSSKNVRTQIGQKPSKCEKCGKAFSCPKAFQGHVRSHTGKKSCTSK

SEQ ID NO: 791529 - protein, 123 aa, Homo sapiens
RALWLPGACEGCQPTWPLPYMGVEAEAWRETAFSRGTNEAWKGPGQHLSVQTPGWCSFQNSPLRGLASSSCELVTGPAHVSPRAPMKMAKCDRNMGFGVIEPWVPRCKSVPTSSTFCDDGKRL

SEQ ID NO: 791530 - protein, 67 aa, Homo sapiens
EDGSMGIAWFFLLQLSEEGEIVDLLLMKILSFLGIKSKREEPGSSREQPGSLSQTRHSRPAQALPKD

SEQ ID NO: 791531 - protein, 93 aa, Homo sapiens
GVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 791532 - protein, 137 aa, Homo sapiens
MAQEFEATVNYLTALQPERQNETPSFKKKGTEMTPSNPTSYARLYFHPISEEFLSLLGFLWLHTQILLALYNMDGLSVLCSVPAQDATCPELEPTRQGASLLSLVKGRWLEVDILDSSLQALTSRKTNKQKQAVSLN

SEQ ID NO: 791533 - protein, 140 aa, Homo sapiens
MEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLGGAPGDVTQRQ

SEQ ID NO: 791534 - protein, 217 aa, Homo sapiens
MEAKTRELIARRTTPLLEYIKNRKLEKQRIREEKREERRRRELEKKRLREEEKRRRREEERCKKKETDKQKKIAEKEVRIKLLKKPEKGEEPTTEKPKKEERRLILEVASRNPVPPVQSSAVIKSPGMWRDLKNQNLKPKDSMLDDGRRHRAHHEPERLSRRSEDEQRWRRRQESSLRIREEKREERRRRELEKKRLREEEKRRRREEERCKKKETD

SEQ ID NO: 791535 - protein, 79 aa, Homo sapiens
PPRLWAFAARFRALRSQASWGWGQENGEGPIQALHLSSTFRQAPPAIRDETLAVFGGRRESLPLFPSPSGSFALPSRLQ

SEQ ID NO: 791536 - protein, 185 aa, Homo sapiens
FSSFGDVACMAICSCQCPAAMAFCFLETLWWEFTASYDTTCIGLASRPYAFLEFGSIIQKVKWHFNYVSSSQMECSLEKIQEELKLQPPAVLTLEDTDVANGVMNGHTPMHLEPAPNFRMEPVTALGILSLILNIMCAALNLQPVQHVYLGQLDLGAHPERALLEERKEIFWSFKLNDTVNHLIQ

SEQ ID NO: 791537 - protein, 100 aa, Homo sapiens
QSRPRCPPFVPLPSYGGSGWLLGWGTEKPARLTDQTSQICPRVYGETEAWRGAACPGYLLGLPPLAQAAVGPSQMVVHLGHIYVCGPSTSGGMSATWSWL

SEQ ID NO: 791538 - protein, 74 aa, Homo sapiens
FSRLFSANCVSFFSWAQVGGPTFLVDGNFICSSDITILFTLRVDDVRLRVLCLCGGAFPCTSDGFIVELQMSSG

SEQ ID NO: 791539 - protein, 141 aa, Homo sapiens
LFSVFAVASAWNPRFSWSLSGLFSSFKAQCEGSLILGALPEAPESPSPFLLAPSQSLRFLVFSCWLCPVSLTVSSGGELTVTHPEPQDCVLPFLPPPCPLDAGSCSLHAWITEAICTLKGRRCRPGTVAHAYNPSTLRNLA

SEQ ID NO: 791540 - protein, 117 aa, Homo sapiens
MASVALEDVAVNFTREEWALLGPCQKNLYKDVMQETIRNLDCVVMKWKDQNIEDQYRYPRKNLRCRMLERFVESKDGTQCGETSQIQDSIVTKNTLPGVGPCESMGEIVMGHSSLNC

SEQ ID NO: 791541 - protein, 128 aa, Homo sapiens
TSHHLGLSLQPTLRAALTRYRPARRYRRALGAGRWARRLSLPRAARPLLSERKNCAAREAADALWSGPCRMAWAGTRPAPLGEAICPWVGRSLTVGLGCIREWQGHRTAGTVTEHMPLFHALCRAVSA

SEQ ID NO: 791542 - protein, 119 aa, Homo sapiens
GASFGLPMAAHGSISRHFLHPIKASGSGRARERMEGQEDQLQREAALSANSRRRWDNQLHRGTTLSAESFRDLQRLRDYSAERSKEHPLQGLLSAESSRCWEDLPTERSYPLWVSSELF

SEQ ID NO: 791543 - protein, 101 aa, Homo sapiens
RGELALIIGIIIIFKKRKKLGMGRKKMKPNPVPLSVFFESTRKWTQEAGRPARRAPRAPALVSNSRRGAKAASARAPAAARRAVAAGGEEKMGHCPSDQSI

SEQ ID NO: 791544 - protein, 105 aa, Homo sapiens
DEKQKLWTVAKSPSSQGWGGVSPQPAWFRHTFHCRSERNPCHHPTESAWSLLLKCLETVNEGAISINFVVLSSSEMTNLHEGGVVQAWASIKIKKCALHLRQWWD

SEQ ID NO: 791545 - protein, 105 aa, Homo sapiens; identical to SEQ ID NO: 791544

SEQ ID NO: 791546 - protein, 107 aa, Homo sapiens
HILPPANILTPLHSGDQLFSNAGAGNSLFTAVEAILLGNSLRSSLERESLTDSAEVLIWRCPNLGETLPTICLQAVFWSSQIRTLWTGGKICMRGSPAACGLAACQA

SEQ ID NO: 791547 - protein, 126 aa, Homo sapiens
LSRLDVYFSHNPAGTSVQNMLHWSQLLNSTHLKAYDWGSPDLNLVHYNQTTSPLYNMTNMNVATAIWNGKSDLLADPEDVNILHSEITNHIYYKTISYYNHIDSLFGLDVYDQVYHEIIDIIQDNL

SEQ ID NO: 791548 - protein, 244 aa, Homo sapiens
TVGQDVDTQKKRRQRTGRKIKKVTMGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPDYKEPGVFNGKRVLVVGLGNSGCDIATELSRTAEQVMISSKWALGDEPGLDMVSLELCCTNWTS

SEQ ID NO: 791549 - protein, 247 aa, Homo sapiens
GWYRSGEVRMCRRCKPELRQNFQSASGICICHWLQIRRTRSREGRAMWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 791550 - protein, 106 aa, Homo sapiens
GPFTCPEHTVIRDSWDPSSRLSDSWQALPCTLAIFQPVFSAGPSNSTMERCPVRSPFRPAPPVWFLTHSQLSFELGMVTCVCDLSFSKVQAGGWLEPRSLRPGWAT

SEQ ID NO: 791551 - protein, 108 aa, Homo sapiens
AVGTAAALASPGISGAPSCGCSQPRQPESRRKAPAKAEAARVLAGRPITGLAVLVRDSLSAIFLRGSGKRQPGLNSSGDNPGLEEGHVAICRLYFSYCEHPCALLPKT

SEQ ID NO: 791552 - protein, 118 aa, Homo sapiens
MHIRQQKKSFKPPFREQLPVWGPAGLWRPTPQTLSSRRTSQGLLSKPVPPPAPGGLASRVGRGSVSGALSPEWNGERQHHRGVVLTHPQSPNHQAGSPNPNTRQALATLSVPNKPFIE

SEQ ID NO: 791553 - protein, 132 aa, Homo sapiens [sequence omitted]

SEQ ID NO: 791554 - protein, 104 aa, Homo sapiens
THRIRLKACPSASSAPIDSGFMLAPKDTGSRPSHVNTSSRHAQVDQGSRPTPMDPGTRLHSVDTGIRPAYSMTQALGYPTQGLQQQASSWASSAFLPRISEQAD

SEQ ID NO: 791555 - protein, 291 aa, Homo sapiens [sequence omitted]

SEQ ID NO: 791556 - protein, 208 aa, Homo sapiens
MDFENLFSKPPNPALGKTATDSDERIDDEIDTEVEETQEEKIKLECEQIPKKFRHSAISPKSSLHRKSRSKDYDVYSDNDICSQESEDNFAKELQQYIQAREMANAAQPEESTKKEGVKDTPQAAKQKNKNLKAGHKNGKQKKMKRKWPGPGNKGSNALLRNSGSQEEDGKPKEKQQHLSQAFINQHTVERKGKQICKYFLERKCIKV

SEQ ID NO: 791557 - protein, 189 aa, Homo sapiens
MANAAQPEESTKKEGVKDTPQAAKQKNKNLKAGHKNGKQKKMKRKWPGPGNKGSNALLRNSGSQEEDGKPKEKQQHLSQAFINQHTVERKGKQICKYFLERKCIKGDQCKFDHDAEIEKKKEMCKFYVQGYCTRGENCLYLHNEYPCKFYHTGTKCYQGEYCKFSHAPLTPETQELLAKVLDTEKKSCK

SEQ ID NO: 791558 - protein, 291 aa, Homo sapiens [sequence omitted]

SEQ ID NO: 791559 - protein, 116 aa, Homo sapiens
TPSPSLLPVPSYLQGQEGIFLYLCVNTAAHKTKFCSHFLTATLCLRLDLRCAYTSCWVLHWEDSSQKKLAQGQEVALVIPVREFQGPGSWGHSGYPGFGCWPGDFSPHKKSQVGVL

SEQ ID NO: 791560 - protein, 147 aa, Homo sapiens
RSCLSRRKWRRQSLGPASARRGPGPPTNNPTSRPSEAQPLEVPGGTEHGCSPWEPLSNSAAQTPFFPPLHPTAPSCPLGLPGSPPGNPPAPKPLPRLCLQGNPNQDTSLLHQMQCVFLLIDMERPSGETQESGDNDRLWRDTSRRHQ

SEQ ID NO: 791561 - protein, 103 aa, Homo sapiens
LLSAVSIQLQGSIAGQKQALQYKAAHFKASRLTFVVCAYSSYKLLFIKIVNSPLFCPHPLLRMRGWQETINTKIYVATTTIWPVERCLCRKKHKKTKRKCVNF

SEQ ID NO: 791562 - protein, 154 aa, Homo sapiens
VVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHR

SEQ ID NO: 791563 - protein, 92 aa, Homo sapiens
MDELLRERDILNKNMLKAVNATQKQTDLVKLHEQAKRNLEGEIQNYKDEAQKQRKIIFHLEKERDRYINQASDLTQKADSVRMPWPLDKGKW

SEQ ID NO: 791564 - protein, 132 aa, Homo sapiens
MASTAPRLCMLRDACRPALSCPQSPLGFPPVPVGDQSLEGAKMTGVLHVNTTQSTYTPSWVATAPRLSFNFAPKIRVDTGSGEMPGSGSRQLQACMTGGLPGSPRAEGCLGPELWLGSCSCAWELRAPALPT

SEQ ID NO: 791565 - protein, 213 aa, Homo sapiens
HCLQWVVPALQVYHKGISRHLFLTWNEWSSVVLFLLFASVFLLLLVFNEGPAQVLKEPQTLNQGLGAWRAGKSHTTLVPASKWMPPALLYKRGCCVSVHPSTEPGRAFIQKHLEEANPFGVDFSSQALSISSHRIKTSQSACIPHLALTQHGALQKSVAPPKAKVQCEMCLGKGAASTLLGTAPAACTAPSYPSFSPGGWPMVAPTSPLHGFS

SEQ ID NO: 791566 - protein, 181 aa, Homo sapiens
SVECRAPAGPVSVVAIIEHVGRGWWGQCPKIPGTRIGRKNCLISVCQGKQSTLGEARNPALTGAAASREDELCLVPWATSPGLGWTSLWTSCGFSSGISPFRLVSQGRPSVGELWATAGGPLPQGLYWTWLWWMRGQGLRQKGGQVPLSRTKGSRPALYLRSMGTRWGPALCDLVWVTHIP

SEQ ID NO: 791567 - protein, 482 aa, Homo sapiens
MARKLSVLEVLLIIFCLIVVTIDILLLLLVLEETSDTSFTPECPEIPQSERIDCTPDQEVTEDICRWQYKCCWSPVADANVPRCFFPWNWGYEASNGHTNTSTGFTAQLKRLPSPSLFGNDVATTLFTAEYQTSNRFHFKITDFNNIRYEVSHENINLVDGIADASNLSYYVEVTDKPFSIKIMRTSNRRVLLDTSIGPLQFAQQYLQLSFRLPSANVYGLGEHVHQQYRHNMTWKTWPIFTRDATPTEGMINLYGAHTFFLCLEDARGSSFGVFLMNSNAMEVTLQPAPAITYRTIGGILDFYVFLGNTPEQVVQEYLELVGRPFFPPYWSLGFQLSRRDYGGINKLKEVVSRNRLAEIPYDVQYSDIDYMDGKKDFTVDEVAYSGLPDFVKELHDNGQKYLIIMNPGISKNSNYEPYNNGSLKRVWILGSNGFAVGEGYPGPTVFPDYTNPVCTEWWTDQVAKFHDHLEFDGVWIVSYYS

SEQ ID NO: 791568 - protein, 135 aa, Homo sapiens
MTAGLQVWVQYKLHLTPSSDKSSPGGFIEQSLWGSLHGAPFCPRAEGVSSGCAGACLALPTRTLFSTHLCPKHSCFRLCYGQTPGFLEVMPVLLPSAPSEQRCPRDQLEGSLHTCGCYPTCHLKMTPCPSSEVRN

SEQ ID NO: 791569 - protein, 82 aa, Homo sapiens
YTLSNHRDTPLWFGIIISVFEQGNVTSQRTHSQYSAELEIKPGPSKAKAICLFTGPLWKCFSTLMMAPVTGSSHQDCDLPGI

SEQ ID NO: 791570 - protein, 146 aa, Homo sapiens
EKGIGRRALLGEGHCWEKKGIARRRALLGEEGHCGEKGIAGRKALLGEEAHCGEKGIAGRRALLGEGHCGEKGIAGRRRALQREGHCGEKGIAGKRALLGEGCCWQKGVAGRRALLGEGCCWENGIAGRGDSQREGWRVGGKRKLR

SEQ ID NO: 791571 - protein, 68 aa, Homo sapiens
LLGEGFEALLSLLGRPCSQGCRGIIVQDRAGEQRAGPCPRLCVGDRGEPALPRALGTATPARGELDQA

SEQ ID NO: 791572 - protein, 83 aa, Homo sapiens
RERGPGSLGRPGQRPLTSSRRAAESSVPRGNERDEGLELFHRLREGRERTVFAPLLQIALALLKDALQRQPKSKKGLLGLFCG

SEQ ID NO: 791573 - protein, 97 aa, Homo sapiens
NECIHLLSIYYTVGTWGYHIKYIIVPIHLELTQVMKLCLFAPLTIQSKSSYVGPSKVGNGEEERLQVERHPYRGWEPPKGPALRRNAEFRAGTRSTK

SEQ ID NO: 791574 - protein, 136 aa, Homo sapiens
MREAEAGPPQVGLSRPTCSLPASSPGPALPPGCVSRPDCCLPTTSLDSAPAHLLAALVGPQLPQAKLPRPRSGLTVASPGSAPALRWRLQAPNGLRSVGSSAPSLGLLATSAGPSRPEVGVSRPCLPASKQALWAQ

SEQ ID NO: 791575 - protein, 297 aa, Homo sapiens
GTLRRGVSPCLTLAPPTLREVGVSPLPHTGPSHTDPLAHTGPSHAERGQREPLPHTGPSHAERGQREPLPQQATVREEQGRTQAAGSRQGLGRGRRGGARAGPGDAPGRQQRGLLTLFCCQSWDCTGHREAGCGPEELGCRNFGVYKTLEGAEPKELACWEAGAGPRDAARRNSWACRGRHEGGRGRASSSRPLQTHMQPPGVLSGPSSSSRLRLQARLLPPNNLFGLSACPSPGGLGRPTASSSQAPQAQVRPHGGLSRISSCPPMASPGPKRSPVGGLLRAQLGPPGDLCRPKSS

SEQ ID NO: 791576 - protein, 140 aa, Homo sapiens
QGPANMGLIRTKTVKKAAWGIIEKYYMCLGNDFHTNKRVCEEIAIIPSKKLCNKIAGYVTHLMKRIQRGPGRGISINLQEEERERRDSYVSEVSALDQEIIEVDPDTKEMLKLLDFGSLSNPQVTQPTVGMNYKMPRGPV

SEQ ID NO: 791577 - protein, 35 aa, Homo sapiens
KPGPLSVPPARLTMCAFTHPIRNLGGILYSSVTYP

SEQ ID NO: 791578 - protein, 109 aa, Homo sapiens
AAAAASHTYTLTGGGAWTARSRDMEQQEDQAEAEGASKRQHYEQKCLREGEKRQVVPAAASKEGQGLSLPEIKTKQEGWVGWKEPPLPSHSPQTEMRLRQATLKGPGCP

SEQ ID NO: 791579 - protein, 147 aa, Homo sapiens
MHLGALFPFLHLPAHGIAATLMERPLIWHLPGLFPRPQFCPCSCGCFLHCGSHGEETRVPLVESGKNSIFTSLPANDHSSFTTSAGTYLGKETGPMWWPSLRCGRASGVALMHSTAQACGHHSPWAAWHLDSFPSLAEVCVALQGRI

SEQ ID NO: 791580 - protein, 96 aa, Homo sapiens
IRQHLPHSLQASPLARALSHQETEGRDFWAALGAGTVPYLLLLGFPKSSDIRPSWGEKYQYPDTSAPCYMTGLASGISYKEEEEEEERTAWSHVYI

SEQ ID NO: 791581 - protein, 163 aa, Homo sapiens
MLRQDQSKRGHCLCGPSGASSKAEPGFGPSLQGHLPPLPARPGLAAEAEGRQGCLSPLFGGVYTCRCQGVWTVGVGGLPGPDFPRPILTLVGEALGEGCGLGGGARPAETYRTVEHLGLPPNSTRSSEHQLQSPGSRRAGPSPLSPILKAGRNPEGSFHQGFP

SEQ ID NO: 791582 - protein, 108 aa, Homo sapiens
MGRVFITRTPKAMATKTKIYKWDLTKLKSICSAKETIIRVNRQTTEWENIVAIYPSDKGLICRIYKEQIYKKKKKTSKREQRVRTDTYQRRHLYSQRTCEAKRVITGH

SEQ ID NO: 791583 - protein, 154 aa, Homo sapiens
TLHNLIVHLRAWPPQGKLTTTLTKVAAKEFRRLTRDPRSCWTQQTAKQSGKHVVFLVSHCSFDIGTCYFHLFSGRIPANPRTISFLIRVLDLGLTAEPLRRGTRNEAPGRREAAGGAITSEVQEASAAQRKGRCVRENLNGDEESSGDWSLRRV

SEQ ID NO: 791584 - protein, 120 aa, Homo sapiens
PHPCQLSFLFLILSQGGHTVPPPLPGQKNVFFCTALAVAPGSPPRRSHSRKWGTCHRCPGGAAGAGKHPQIRTSVRARESNTKLGVLREGKRALQESFIPTDNTHPIKTPGQASPGSWAT

SEQ ID NO: 791585 - protein, 34 aa, Homo sapiens
GQRIMESLPLRCILPFTYKQAHATVLKIHTLDDI

SEQ ID NO: 791586 - protein, 35 aa, Homo sapiens
MPLLWKGFYAVILFGFAILMPIVFVVIVIVAVVVA

SEQ ID NO: 791587 - protein, 122 aa, Homo sapiens
DDLDMDSSEGSSPNASPHDREEACSPQQEPQGCRCPLDRFQDFALIDAPTLEDEPQEGQQWEIALPNNWQRYPRTKVEEKEASDTGGEEPEKEEEDLYYGLPDGAGDLLPDKELGFEPDTQG

SEQ ID NO: 791588 - protein, 168 aa, Homo sapiens
VKTVIDDLIQKLFDLLVLSLKKSIQAHLHEIDTFVTEAMEVLTIMPQSVEEIGDANLQYSKLQERKPEILPLFQEAEDKNRLLRTVAGGGLETISNLKAKWDKFELMMESHQLMIKDQIEVMKGNVKSRLQIYYQELEKFKARWDQLKPGDDVIETGQHNTLDKSAKL

SEQ ID NO: 791589 - protein, 159 aa, Homo sapiens
MNAAHTGVGSCLSWPIHRGSVPRNCGTFIRGPLLDKALFCSFQRSFLPYAPSAGTQHVCVRACLCVCVCAYGGWLRGQPGLLVCEMPKVLGGRDAPPWSRKISRRAESFKDGAHPHCSLIVLLLTTQSVSPGVATAAPTRRRGAASCCRWSAQAGLPAA

SEQ ID NO: 791590 - protein, 118 aa, Homo sapiens
LTAAHPFSLQYVVRILPFPTMNPPAEIPVHILSTKNLNLKEWLKEVRRHLQHFYWRSPCLDHQILTVLPRLQCSGAISTHCNLYLLGSSNSPASASQVAGITELMVFKQLVVKIWWKR

SEQ ID NO: 791591 - protein, 106 aa, Homo sapiens
LTAAHPFSLQYVVRILPFPTMNPPAEIPVHILSTKNLNLKEWLKEVRRHLQHFYWRSPCLDHQILTVLPRLQCSGAISTHCNLYLLGSSNSPASASQVAGITGITH

SEQ ID NO: 791592 - protein, 102 aa, Homo sapiens
LTAAHPFSLQYVVRILPFPTMNPPAEIPVHILSTKNLNLKETSKYTGPLYSNRSVTLRQQSLQQRKSLMLTGYQVAQRGQEAPSTLLLEISLSRSSDSHCVT

SEQ ID NO: 791593 - protein, 109 aa, Homo sapiens
LTAAHPFSLQYVVRILPFPTMNPPAEIPVHILSTKNLNLKEWLKEVRRHLQHFYWRSPCLDHQILTVLPRLQCSGAISTHCNLYLLGSSNSPASASQVAGITGEETGVK

SEQ ID NO: 791594 - protein, 310 aa, Homo sapiens
MNLSTEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNRDFHNHEEMKGLMDENCILKADIAILRQEICTMKNDNLEKENKYLKDIKIVKETNAALEKYIKLNEEMITETAFRYQQELNYLKAENTRLNAELLKEKESKKRLEADIESYQSRLAAAISKHSESVKTERNLKLALERTRDVSVQVEMSSAISKVKDENEFLTEQLS

SEQ ID NO: 791595 - protein, 92 aa, Homo sapiens
HGAPHPLSRTHCPALPSEMNPVPQLEMQKSPIFCDTHAGSYRLELFLFGHLGSTLMRLIHNHENSTGNTRLHDSVTSHGVPSATRGDYYSSR

SEQ ID NO: 791596 - protein, 106 aa, Homo sapiens
SPLRLLVGDAQAKTVTDTLAHTHARTQAHARRSSPGLATVVAPGAAARARTTASAPPPPRREGPRRTSSAAAPGRQGWGSGREEEQPEPPPPPSPRPPGPGWNLRP

SEQ ID NO: 791597 - protein, 130 aa, Homo sapiens
MFRFVKHEQSPKTFFRPSYVLGNVQVDTVAVRRLNPTPRIMSSWLCSEVQEMLHLLGQVETPACYPVSHGLVAAISPPWDKSLSLVSNYSSASRGRGPGGFRLGAQLGVQQPCPGSTLISRNGFNQRIGL

SEQ ID NO: 791598 - protein, 117 aa, Homo sapiens
SSYPSYIVLEKGSRYIAQTGLELLGSRDLPTLASQSAGFTGMTPSCFSIPKREVSACLHLHCRSSFLPGLPTYSFPFLQASLFSIHQSELMVFKIKLENITPAPNYPWFPISNKISA

SEQ ID NO: 791599 - protein, 70 aa, Homo sapiens
KKERRGSWEQGSEAGEVPDSLTHSLIHSFPHTLSRHVPSTSFVPGPIWMSMPGERQADLGLPGWRTDEDH

SEQ ID NO: 791600 - protein, 75 aa, Homo sapiens
GFERRYPLGLGKKGLGLGKKGLGLGKRKLPGPPEAELSREREICPPAHPALGDQSGTPVLKKKKKKKRPLEFHLG

SEQ ID NO: 791601 - protein, 107 aa, Homo sapiens
WAGKESLRHVRTKRLPRIGHFLWLHPCCWLCLLAPVTLDRGGSFEAHREKEASLTVLFAIVHSFFTCSACPLQYFLVERESLRAEGEQSPSSGQLFLARLPINLFGW

SEQ ID NO: 791602 - protein, 218 aa, Homo sapiens
LQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQILQDSLDRCYSTPSMYFELPDSFQHYRSVFYSFEEQHITFALDMDNSFFTLTVTSLHLVFQMGVIFPQ

SEQ ID NO: 791603 - protein, 105 aa, Homo sapiens
MGIGTGHTSMNKGGKDVTLLELSVEKRRWRINMETSKIILEKMQSDDVLDGNRERSNEREGRDSLSEKLKSKQNLKDEEKLRYIKTGKSIQVEGTVRAKALRWVQ

SEQ ID NO: 791604 - protein, 100 aa, Homo sapiens
FGTRAAAFFPTRGFFCFLTLRICVFLSLQEDAAAHAVGNKWAGISPEVSLYGGLGLGAPQSSQGRSDRPLCNFSPPLRRPSHSGCSAPAPSPSHSGSSRG

SEQ ID NO: 791605 - protein, 128 aa, Homo sapiens
MSLCSACTSPASHQLLLNCQGQTVAKSHSSADAGVSLVSGRWCAWWPEHCSESMFPSQHPVLSSNLADSSGQGRSPAGAHPALCPFHKSPWFPHFPQILPREWSWCGPERPAGCSLGLKAEAALVGKK

SEQ ID NO: 791606 - protein, 101 aa, Homo sapiens
LTAAGHKLAVVQFSSKRCGPCKRMFPVFHAMSVKYQNVFFANVDVNNSPELAETCHIKTIPTFQMFKKSQKVTLFSRIKRIICCYRSGFMSNLCLADDGNE

SEQ ID NO: 791607 - protein, 229 aa, Homo sapiens
QSIGTVPTVDLASRYECAAVVLHSPLTSGMRVAFPDTKTTYCFDAFPEVSGPGGDGGGAGTGGRAGPGPGAKSHPLHAASRSIEKVSEITSPVLIIHGTEDEVIDFSHGLALYERCPKAVEPLWVEGAGHNDIELYSQYLERLRRFISQELPSQRAYRRPHRPDLSNKAAPGPHPAPAPQGLHVDPPGGPGDPAPDPGAVDDVQATELRTPFLLEARRKYVKTEIKDLK

SEQ ID NO: 791608 - protein, 126 aa, Homo sapiens
DKVSLCRPGRSAMARSQPTATSAFHSRFSCLSLLSSWDYRHAPPCPANFCILVETGFHHVGQAGLELLTSSDPPASASESAGITGVSHCTWPQLVFPNRCIQKICLHFSSAASVPLIMFALLSLLS

SEQ ID NO: 791609 - protein, 88 aa, Homo sapiens
KSLPYEERSPLVEKMNTRMEAHRSERGGLEEGTRVRRWAPPALGQSQRKDRGRKQEHSGQGALAAAHSSSSSGGRGLAPAQCPHVREW

SEQ ID NO: 791610 - protein, 116 aa, Homo sapiens
MLCSSRLTSLVSPQLTGHTPCSATDPHARSHTQPVCGQPLCLEGSSQRPWARGAVRLSVYPVHMHHIPSGSRFVQRFLAPSGLFHRAGTRGRKSLVFSPSIGPSIQVISKNVTWMS

SEQ ID NO: 791611 - protein, 285 aa, Homo sapiens
SGRPVPASPVKATGVSRGSARARDDGRDGQVWARGHAARRRESQVLGAWASEDAQRSLAARRRSSAGARRCPKTLPASERAEPRASPGDNPKSALMEEEKYLPELMAEKDSLDPSFVHASRLLAEEIEKFQGSDGKKEDEEKKYLDVISNKNIKLSERVLIPVKQYPKFNFVGKLLGPRGNSLKRLQEETGAKMSILGKGSMRDKAKEEELRKSGEAKYAHLSDELHVLIEVFAPPGEAYSRMSHALEEIKKFLVPDYNDEIRQEQLRELSYLNGSEGLWSWQRY

SEQ ID NO: 791612 - protein, 141 aa, Homo sapiens
VGTFFFLRQSLTLLSRLESSGAISAHCNLRLPSSNDSPASASQVAGVTSTHHHARLIFCIFSRDRFHHVGQAGLELLTSGDPPASASQSAGITGRSHHAQPKHFYLTKNSSKTLGAATMQMNGHIYKKGVYIYKDCYHIYH

SEQ ID NO: 791613 - protein, 139 aa, Homo sapiens [sequence omitted]

SEQ ID NO: 791614 - protein, 76 aa, Homo sapiens
NPSELLARTEPKSINVAKKFDLRKVICRKTFSCPKGCTSESLVLLLGQILFDSLRTVKKIATKWNHQYRIPGSTGP

SEQ ID NO: 791615 - protein, 481 aa, Homo sapiens
MKGRGMLVLLLHAVVLGLPSAWAVGACARACPAACACSTVERGCSVRCDRAGLLRVPAELPCEAVSIDLDRNGLRFLGERAFGTLPSLRRLSLRHNNLSFITPGAFKGLPRLAELRLAHNGDLRYLHARTFAALSRLRRLDLAACRLFSVPERLLAELPALRELAAFDNLFRRVPGALRGLANLTHAHLERGRIEAVASSSLQGLRRLRSLSLQANRVRAVHAGAFGDCGVLEHLLLNDNLLAELPADAFRGLRRLRTLNLGGNALDRVARAWFADLAELELLYLDRNSIAFVEEGAFQNLSGLLALHLNGNRLTVLAWVAFQPGFFLGRLFLFRNPWCCDCRLEWLRDWMEGSGRVTDVPCASPGSVAGLDLSQVTFGRSSDGLCVDPEELNLTTSSPGPSPEPAATTVSRFSSLLSKLLAPRVPVEEAANTTGGLANASLSDSLSSRGVGGAGRQPWFLLASCLLPSVAQHVVFGLQMD

SEQ ID NO: 791616 - protein, 481 aa, Homo sapiens; identical to SEQ ID NO: 791615

SEQ ID NO: 791617 - protein, 172 aa, Homo sapiens
MAASRSTRVTRSTVGLNGLDESFCGRTLRNRSIAHPEEISSNSQVRSRSPKKRPEPVPIQKGNNNGRTTDLKQQSTRESWVSPRKRGLSSSEKDNIERQAIENCERRQTEPVSPVLKRIKRCLRSEAPNSSEEDSPIKSDKESVEQRSTVVDNDADFQGTKRACRCLILDDC

SEQ ID NO: 791618 - protein, 158 aa, Homo sapiens
SHGVGVAGHGDLEESEDPAGLQVFSAEPQGDSPAAPDPSGGSPSIRDVPGLTPKAPLSVIWQGQPRSEGSPGQGSPPPGPGTPGSVHRPEGPPSAWPPLGGALRDRRWGGDWAGEMERAAHPQGRRRRRATAQPGNGSRGGASALVDPARGVAGAAAA

SEQ ID NO: 791619 - protein, 104 aa, Homo sapiens
ANSQLCGGIKRSREPSWVPETPDCLHLQLPGSLQPGSVDFPRLSARSSGSVEPGGMDEASRAPSSGEKGSLPNASCGPSRVPWAMAPAGSSSPGAGIQDAEARK

SEQ ID NO: 791620 - protein, 730 aa, Homo sapiens
MQVFYSPVIFCFSWCLRRPHFPGQGPPCSWKTDYVGPLTSTQGWHCSRLCCYCPSLVSQLQPHHQSAWFLLSVCSLTMEHLLSRKPLRSGQMTFHAIAIHRHQALLSTGSVSSKTDSKTSDFGLLLVTRLTKTRCSLNVAVPEKGPSSLGCFLSNDQNEGARNHLDLFGKFDEPFLIIPGHEASLFTLTTPPGPRGYCTPVSPARSSLILMRPPGCSCRIAMDSDRWDRDHWLRAPPPDPPTVVHTGQNGGRDRPLETLLKSSVPLAPDCPDGKSGSEQGHGEQSKAPATDIGHTNFIPVEGEEPPQPQEPRPTPQRRTTSASGASAHTPEKNHLSLKSLGPHPGEEPPQPQEPRPTSRRTTSASGASAHTPLPPLRGKRGGAMNDLFPLLSSLVSVFLVKENNLVPLTQTITSTLTDCWLSHRHQAALNTAGLPLPLTYREIFGNSRGGPRLDWQCGQTGQGKWMALKQSLQSREGLHPVAQTELETVRFTSRSGGYIVVIVKVHFSVHTGPNSQEKPNLGVPAIVTHTLFSEAPRVPQIYTPCMGGSQVLSCFSSPKRAFLSPYTLWILLRMEVDTIDRPCSTPTAMQIENRAAVLTLTLWAVRYDGNHPVRKMAWNLSLTSNEVINGIALEGKQVSLHSPARVVRDGSIAPDSLLVAQSITNSVIHTLGRKEMTVNGSNKGTPQQGTQARRTIVLFHSGFAELLLLGLAQMLTGSSLRPGVGHTSFP

SEQ ID NO: 791621 - protein, 297 aa, Homo sapiens
RKHQMADDAGAVGGPGGPGGPGMGNRGGFRRGFASGIRGRGRSRGPGRGRGRGARGGKAKDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATATRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 791622 - protein, 42 aa, Homo sapiens
LCPHRWPQRDRGIPTLQYQTQRDLEDCKHEMKKICKAEVTLE

SEQ ID NO: 791623 - protein, 139 aa, Homo sapiens
WKIQLWYKATLASHKSYLPIKLKQMFLLPTSSHPAFPPPACLQQHCTLRRRAEAFPTAAPDLHKAKLTHPADPNKCRICPDAFPNSMGCSLFFFPSNSSTTALYYSNVDINLILSSLQRTCLVYVPILLTPWTCSESIT

SEQ ID NO: 791624 - protein, 120 aa, Homo sapiens
MQFFASFKLGSGRQSCTTHRCRAQDSLLGLPGLGCACCPCGQHTRTFHLKARIRRTFPEEVVVWHYDLSLPKKVIELHWREQHPGAAGMGLGLTGRGSVSGWGLGSCAAPVCQKHSVNLC

SEQ ID NO: 791625 - protein, 100 aa, Homo sapiens
PTRPAFIAPCGPHKGDGIYEFEVPGFKIRGSWELREQVGAERTAPQRPGAEAVRATPGAVSASVTAFIAPCGPHKGDGIYEFSFPSLLKNSFMPGAVAHT

SEQ ID NO: 791626 - protein, 273 aa, Homo sapiens
EIEASAVYFRCRYRVSLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLP

SEQ ID NO: 791627 - protein, 273 aa, Homo sapiens
GQEQAGGEELINKSSPLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLP

SEQ ID NO: 791628 - protein, 336 aa, Homo sapiens
MTTLSPENSLSARQSASFILVKRKPPIDKTEWDSFFDESGHLAKSRDFICVNILERGLHPFVRTEAWKFLTGYFSWQSSQDERLTVDSMRRKNYKALCQMYEKIQPLLENLHRNFTETRNNIARDIQKIYDKDPLGNVLIDKKRLEKILLLSYVCNTQAEYQQGFHEMMMLFQLMVEHDHETFWLFQFFLQKTEHSCVINIGVAKNLDMLSTLITFLDPVFAEHLKGKGAGAVQSLFPWFCFCFQRAFKSFDDVWRLWEVLLTGKPCRNFQVLVAYSMLQMVREQVLQESMGGDDILLACNNLIDLDADELISAACVVYAELIQKDVPQTLKDFFL

SEQ ID NO: 791629 - protein, 156 aa, Homo sapiens
AGSVRTEEVESRAYADPCSRRKKRQQQEEEDLNLEDRGEELVLGCWKQGKQRAEHAVMKEEEEATASERNDADEKHPEHAEQNIRKSRKKEKKRRKEKTKKKKKRQERQEERKEKERKGERKKRGKERRKGKQNKRKVVEQKNIVTKFNFIQWADE

SEQ ID NO: 791630 - protein, 47 aa, Homo sapiens
MAAPCCVLQSSQTLHLRPWACINVKALQCYHVETDDRNPANEQKGCD

SEQ ID NO: 791631 - protein, 143 aa, Homo sapiens
MQNRDCSGKNEWLCDDEIPGRHRATCGGASGRSRSHPRTLPPALPPSRRRAGSTCVCLCAEWGRGRCRRRGGVRANVTGGAAQSAAGSRPRRWYWGSEGAVLYNAVSGSQRGRKKPSGRKAPSPPPGPGHRVPGPGSFPPPAA

SEQ ID NO: 791632 - protein, 102 aa, Homo sapiens
HAGKWSVFKENTCFARIFHLISCNFFSKTSFISEGMKVGGHTRLPHPLAGCPLAMELSKASSLETGHPTRPVRAQDTGAQTRPAAKYRWSDINPVSLSSPGT

SEQ ID NO: 791633 - protein, 107 aa, Homo sapiens
CTDAVWKAPPEICSDGRVYSSISNTHAASPCLGLPGSLSKNSQGIFLPWSQQPSSPSMSLIGHTAFPFLLLSFYPPSLFLKTSPASPLAPALSSHQQNMQVVVSLLR

SEQ ID NO: 791634 - protein, 101 aa, Homo sapiens
LNDVALNPRSLQKCHPLREKQAFALGCFKDPVIITINKHLEMLPYYAGLEQEERSESQAIQSDCKKGSDLGKSQGFSHSSLWGLQCLKVNFPPPLVPTVWN

SEQ ID NO: 791635 - protein, 265 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSPQEKTLCK

SEQ ID NO: 791636 - protein, 345 aa, Homo sapiens [sequence omitted]

SEQ ID NO: 791637 - protein, 310 aa, Homo sapiens
MMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLES

SEQ ID NO: 791638 - protein, 479 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLES

SEQ ID NO: 791639 - protein, 479 aa, Homo sapiens; identical to SEQ ID NO: 791638

SEQ ID NO: 791640 - protein, 495 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGGEDCCIACVTEELLFLIYSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLE

SEQ ID NO: 791641 - protein, 219 aa, Homo sapiens
MEPKEATGKENMVTKKKNLAFLRSRLYMLERRKTDTVVESSVSGDHSGTLRRSQSDRTEYNQKLQEKMTPQGECSVAETLTPEEEHHMKRMMAKREKIIKELIQTEKDYLNDLELCVREVVQPLRNKKTDRLDVDSLFSNIESVHQISAKLLSLLEEATTDVEPAMQVIGEVFLQIKGPLEDIYKIYCYHHDEAHSILESYEKEEELKEHLSHCIQSLK

SEQ ID NO: 791642 - protein, 182 aa, Homo sapiens
HRALLPPEALGRALPPFQLPLVPVLLGLWPHHSGLCLHLMPRSLKRAQLRSLLPRPPAVSHTQPWYRAAHPTTSPTAASRDVHPASGAVPGPWLVEGTAVREGPQLQDAVPQRPTRPSKALWPAQMSAAPAIRLGQMVPGDTRGLWGPQGTLLTWTYRGGQGGRWTRRAEGPREGTFAEQRP

SEQ ID NO: 791643 - protein, 143 aa, Homo sapiens
VLFPYSTPCPRPRSLKRAQLRSLLPRPPAVSHTQPWYRAAHPTTSPTAASRDVHPASGAVPGPWLVEGTAVREGPQLQDAVPQRPTRPSKALWPAQMSAAPAIRLGQMVPGDTRGLWGPQGTLLTWTYRGGQGGRWTRRAEGP

SEQ ID NO: 791644 - protein, 127 aa, Homo sapiens [sequence omitted]

SEQ ID NO: 791645 - protein, 56 aa, Homo sapiens
MVVVQQVRRRGRRPGRLLLALEGSALEDLSPGAGHGQQGGGLGSQREPRGSGGGGR

SEQ ID NO: 791646 - protein, 88 aa, Homo sapiens
TGMGQWPPICPQRQQLALLGRLLRHRYTSGLRVAPSLLTALVQDALSAASVTCTTDIGLRAPFPGTGGTMVKRSLPCEAFTLVVQGKR

SEQ ID NO: 791647 - protein, 121 aa, Homo sapiens
MGHSEVIPRGERLLRRRPWVDGDERADAELLGAMDHLGFQPRAGLFLGPSKMSSLLDALELQESADTSPEQGPHCPSPPPLSGNVARRCQLRGVPGMMVSTAGAGPGPWRQLSGLRAPVNA

SEQ ID NO: 791648 - protein, 104 aa, Homo sapiens
AAITSTFPCPIQPLSDSNPVLLKRYSWVSGSWWSLGNQKIQRVPVGSQSYTDCEDPGCLSWGPGTTPQYMQKCAREHTHTLRGRKLLLKLFHCFFLLCSNVTNK

SEQ ID NO: 791649 - protein, 118 aa, Homo sapiens
SPLHHLQYWRFTLCRGLERVLICSVHFLQMQLRRIHSRHVFIVREHCACVSSSVNEEMSFSHICIVSENISPDCGSLGAAHTWFLIRLIKRLGMSIAVRQKVVVIQLGAQLPITVIRA

SEQ ID NO: 791650 - protein, 90 aa, Homo sapiens
MDVPYLINCLVFLFCFSKSNEHSSEYPFVRDLSLEGRLLAKNICTFNIHIHIYTHFFLRQRFTLSPRLKCSGMIIVHCSLYLLGSSNPPT

SEQ ID NO: 791651 - protein, 159 aa, Homo sapiens
MACTQAGERTAIYCLTQNEWRLDEATDSFFQNPDSLHRESMRNAVDKKKLERLYGRYKDPQDENKIGVDGIQQFCDDLSLDPASISVLVIAWKFRAATQCEFSRKEFLDGMTELGCDSMEKLKALLPRLEQELKDTAKFKDFYQFTFTFAKNPGQKGLD

SEQ ID NO: 791652 - protein, 134 aa, Homo sapiens
VGGRSTGSWHNLAEVAGCFLSQLGLARHAQFCATTVTQMEPHRENEQQAQEQGVCFLRGSSPCLRVHMALWASWLQRGRPQAIFRRSLCGSAESSQDYHPWDSAFCGPGLTEFGPRQDKLTRSNMSEPGAVHVR

SEQ ID NO: 791653 - protein, 119 aa, Homo sapiens
MGFVRCRIKSVVHRVMPFAVRECKGRAGNSRMGRCVNVDLQVGHKQCLEIPLGKRSLLESGQAEGSLSSGIFLCSSHWLEMENERKRSLFQARDLTNRITTLRPCSRGHKLPSLFPCGL

SEQ ID NO: 791654 - protein, 107 aa, Homo sapiens
MIGSFNSQFPGNHLALCMKLQIGLFCNAALARPHVFHYLWKSAWPWVGTVDVSIRKHILSTETTGQVVDEKCLTSVNLQLLTTRFCFFKGVDKLILIVFTSILLKGL

SEQ ID NO: 791655 - protein, 41 aa, Homo sapiens
STAMFLTDLQMEICNECTKRDSMSDANLWAKSLWDTLLIVG

SEQ ID NO: 791656 - protein, 53 aa, Homo sapiens
MGNAGSESLTLVPGFKRLRASCVQAEVNGDSNCRLALTIRNKNKIRKGIDDRK

SEQ ID NO: 791657 - protein, 111 aa, Homo sapiens
FQVEDLSAQSLQFSPVLSRKISARSRLGMAHLSPLGRKAPASKGVSGAQSRAKLQEGAMGNAGSESLTLVPGFKRLRASCVQAEVNGDSNCRLALTIRNKNKIRKGIDDRK

SEQ ID NO: 791658 - protein, 124 aa, Homo sapiens
EGVQVSQACLSLSMSGREAVSLGRKTKTQAYENHFLTLLIIFPFPPTPSRSLRKWWATCPDLMAACQGHMNPVQDPQRKVLLQWLLALNPHHDAQSSPLLLSAPSHPCVVSSCVQWFPISTWVG

SEQ ID NO: 791659 - protein, 149 aa, Homo sapiens
RDQSSPGLGGGHWPAVCGSFQKHGRSCRGRGGLGQKHWKSLLESVSLWGWGRPGAPQHVRAVPGEGPAGTPFLPAAPRACPAAPSRGSAFPTVLGELGWVGWGGAGRGQLRLQGGRGLLGAPQPPAPRPGSRPRAPGLGHAASGGRLRP

SEQ ID NO: 791660 - protein, 79 aa, Homo sapiens
LVTYKYPQGAGTHEQRDRDKYYRCLRVWISSRRKNKKSPGTTLVDRELVGEAGKPDNKAHGDSEPRVNRLEVRLSSSPA

SEQ ID NO: 791661 - protein, 107 aa, Homo sapiens
MPRTRTPSTSNTHSPSSMTFVFLESIFLSQALATKTPAYRSSVLAQHAWTHSSARQTSWGTFCEQALGRQGQPASVPTVLKRQQARPPQHGEVGTVFTNNKGGQRLV

SEQ ID NO: 791662 - protein, 556 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQGIGRRFWLIDRQNLISLGKRKEALKS

SEQ ID NO: 791663 - protein, 563 aa, Homo sapiens
MIPNIEGMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQGIGRRFWLIDRQNLISLGKRKEALKS

SEQ ID NO: 791664 - protein, 165 aa, Homo sapiens
CIQPELGIRNYALTGGKTRAASVHPASSAPEFPLPGQQWPQEPWRLGTAPCPSSLGRWSGSSRSDKSARYPQMAASVLSQPILERRKRSETSWPAHSQGPGAGMGGLWHPPICHLCKGPGLSFPQREARPNHSLEAQECGWESGRVWQGTKRPVRGTGWLRCQAS

SEQ ID NO: 791665 - protein, 130 aa, Homo sapiens
QALELSLPPRVAQCLPSPCPPVLLFLSSHHSSLSWHSPSEPHWLPSLYSFVGRTQLCQHRALLAMPHLDGAVLEGCCVGGSFELPALSILQRVAASRIVCRRKQGSWSNLSSSSLLWAFPVHLPASPCVP

SEQ ID NO: 791666 - protein, 120 aa, Homo sapiens
SNQLSSPGQRQDSEPALIWVLGRGSQYLSAMLSPSPGSVDPLPASPQQGPGTQIPANVKKTPTWHRKPQLAASSAGTVMWLVIRWAPSPRIWGRAQPGRQLYPALAVSCWAHTLIILSLN

SEQ ID NO: 791667 - protein, 339 aa, Homo sapiens
LEAQSPRRRAGWCSCAGGVLRLGVVTGSRMASDSGNQGTLCTLEFAVQMTCQSCVDAVRKSLQGVAGVQDVEVHLEDQMVLVHTTLPSQEVQALLEGTGRQAVLKGMGSGQLRGDHCGLGPSRREVAQSWYKSNHRILRLWVGVALRKVWKLCETPCPSRAAEEVCWVRWQASPSVFLAENLGAAVAILGGPGTVQGVVRFLQLTPERCLIEGTIDGLEPGLHGLHVHQYGDLTNNFNSCWESLLTLMEHLMGGPQDSDRTGPRGTLPGQSSGSSDSYENWYAQGGHWVLKGNQDEGVESGNQKNAASHHVAPFPITPGVHHHRGNRAGGKVTGGHSEG

SEQ ID NO: 791668 - protein, 329 aa, Homo sapiens
LEAQSPRRRAGWCSCAGGVLRLGVVTGSRMASDSGNQGTLCTLEFAVQMTCQSCVDAVRKSLQGVAGVQDVEVHLEDQMVLVHTTLPSQEVQALLEGTGRQAVLKGMGSGQLQYLAENLGAAVAILGGPGTVQGVVRFLQLTPERCLIEGTIDGLEPGLHGLHVHQYGDLTNNFNSCWESLLTLMEHLMGGPQDSDRHRGDLGNVRADADGGAIFRMEDEQLKVWDVIGRSLIIDEGEDDLGGEGHPLSKITGNSGEEGLAVASCARSVGLFQNPKTDLVLCDGLTNLGEEARRPNRGKARKGVKAAPATFGEELTWVLVRLQGSLSIP

SEQ ID NO: 791669 - protein, 114 aa, Homo sapiens
LEAQSPRRRAGWCSCAGGVLRLGVVTGSRMASDSGNQGTLCTLEFAVQMTCQSCVDAVRKSLQGVAGVQDVEVHLEDQMVLVHTTLPSQEVQALLEGTGRQAVLKGMGSGQLRE

SEQ ID NO: 791670 - protein, 118 aa, Homo sapiens
PEFRGTFRGGVWLGVSFEAAHQLDSPLPGCSHRARAGGLSPAPCGLPTGLRACLWDCHSLFLSRRLERERERARRGHGACMSQSRVLHPVPSATLCSFHVRYQVSPVLREGNCASPFS

SEQ ID NO: 791671 - protein, 161 aa, Homo sapiens
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHQVGYQ

SEQ ID NO: 791672 - protein, 286 aa, Homo sapiens
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADFGLSKVCSASGQNPEEPVSVNKCFLSTACGTDFYMAPEVWEGHYTAKADIFALGIIIWAMLERITFIDTETKKELLGSYVKQGTEIVPVGEALLEN

SEQ ID NO: 791673 - protein, 260 aa, Homo sapiens
SKGTISASCPRSSRSTMAAAASPAFLLCLPLLHLLSGWSRAGWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPGTTQPKAMATTLSPWSLLIIFLCFILAGR

SEQ ID NO: 791674 - protein, 129 aa, Homo sapiens
GFLPSVSPCFPTIYHDTQPASVHEPAVSSYHCRRHPLLGCSRCRVWRKVRSKGALSVETHTPTASLTPRPTHSTVTGFLHRGPADLSSSPNLELDMFSLQMQKDKSLLRGPVVAQSRAKRKYMFLSSII

SEQ ID NO: 791675 - protein, 560 aa, Homo sapiens
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQNKILSSVRKSQEITTNSEQRCPLKKESACVRLFKQEGTCYQQAKLVLNTAVPDRLPAREREMDVIRNFLREHICGKKAGSLYLSGAPGTGKTACLSRILQDLKKELKGFKTIMLNCMSLRTAQAVFPAIAQEICQEEVSRPAGKDMMRKLEKHMTAEKGPMIVLVLDEMDQLDSKGQDVLYTLFEWPWLSNSHLVLIGIANTLDLTDRILPRLQAREKCKPQLLNFPPYTRNQIVTILQDRLNQVSRDQVLDNAAVQFCARKVSAVSGDVRKALDVCRRAIEIVESDVKSQTILKPLSECKSPSEPLIPKRVGLIHISQVISEVDGNRMTLSQEGAQDSFPLQQKILVCSLMLLIRQLKIKEVTLGKLYEAYSKVCRKQQVAAVDQSECLSLSGLLEARGILGLKRNKETRLTKVFFKIEEKEIEHALKDKALIGNILATGLP

SEQ ID NO: 791676 - protein, 560 aa, Homo sapiens; identical to SEQ ID NO: 791675

SEQ ID NO: 791677 - protein, 560 aa, Homo sapiens; identical to SEQ ID NO: 791675

SEQ ID NO: 791678 - protein, 254 aa, Homo sapiens
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQNKILSSVRKSQEITTNSEQRCPLKKESACVRLFKQEGTCYQQAKLVLNTAVPDRLPAREREMDVIRNFLREHICGKKAGSLYLSGAPGTGKTACLSRILQDLKVSRDQVLDNAAVQFCARKVSAVSGDVRKALDVCR

SEQ ID NO: 791679 - protein, 101 aa, Homo sapiens
FLWQQMDNSNWTSVSHFVLLGISTHPEEQIPLFLVFSLMYAINISGNLAIITLILSAPRLHIPMYIFLSNLALTDICFTSTTVPKMLQIIFSPTKKWKSQS

SEQ ID NO: 791680 - protein, 215 aa, Homo sapiens
TSDDPPALASQSAGITGVSHCTQPNFLIWYKVEEGGKADTLSSKLQAGDEVVHINEVTLSSSRKEAVSLVKGSYKTLRLVVRRARFVTQPGVQWCDLDSPKLGSPGLKRFSRLSLPGGWDYSRARWLMPVIPALWKAEAGESLGGRELETILANLVSLYVVAHIRSPSYSGRLGHENPLNLGKWTVRRRRDNALQTGGQSNDSSPKQQKHKTTTT

SEQ ID NO: 791681 - protein, 83 aa, Homo sapiens
TSDDPPALASQSAGITGVSHCTQPNFLIWYKVEEGGKADTLSSKLQAGDEVVHINEVTLSSSRKEAVSLVKGSYKTLRLVVRS

SEQ ID NO: 791682 - protein, 106 aa, Homo sapiens
DSNPILRYRWVKEVAKEASSIPSAAKMPPVITTGLGPNFVLRALPTGLPNCCTAIPMEAIQETRAACSSNAATNSTKKTPKERSTPNTSADWKNAESTTTNHPQPP

SEQ ID NO: 791683 - protein, 81 aa, Homo sapiens
DSNPILRYRWVKEVAKEASSIPSAAKMPPVITTGLGPNFVLRALPTGPEEVEGAAARRSQGSPPQHLPPLALPLPSRRIPS

SEQ ID NO: 791684 - protein, 78 aa, Homo sapiens
HSKAKRKEAGPLEVVVTTPAMWRSLGLALALCLLPSGGTESQDQSSLCKQPPAWSIRDQDPMLNSNGSVTVVALLQAS

SEQ ID NO: 791685 - protein, 75 aa, Homo sapiens
KVDLRIPGSTDVVVYLICALVLDAGGSRVVSQSLWEAMARRITDNPSNVEKPGACPGSLSPPIGRNREPGPKLLM

SEQ ID NO: 791686 - protein, 78 aa, Homo sapiens; identical to SEQ ID NO: 791684

SEQ ID NO: 791687 - protein, 69 aa, Homo sapiens
PFLKNLTIQVLLENSFSTRTVCCKRKLQEFLEEETGDLVHQSRSSFYSRLVFKKLLVCVALGKLEIITL

SEQ ID NO: 791688 - protein, 105 aa, Homo sapiens
LIISDGWAGGAAGRPSQGLGSLQGEKEVGAARAGPCVLHRRFWARNWKQSSPGGLGVQAPKLWLALSLPTPPALFAGTRVLWAVADVETGRMSSYFSKTQCPLPL

SEQ ID NO: 791689 - protein, 79 aa, Homo sapiens
SPRPTGQGHQPWRGHRAQRGQLGCELIPPRPPVLVPAPPPKARVAGWCLAPTPKVGRGLEAIRLQAALGAAPWRQGNKG

SEQ ID NO: 791690 - protein, 82 aa, Homo sapiens
RCCTKPQTQRLLHSTPRPSCCHLCGDQQDDCPSFQRAWYWGAPGEGVPGCGQPVDAHDCDATALGPPLSRVRWEQEPQRSQG

SEQ ID NO: 791691 - protein, 115 aa, Homo sapiens
MPPHHPVGERAGKQGTWAWGRPQGQVLQAGRLWQKPLCQPPPSCPRMQRPAPPRPSAQEARVRKQTEMPACLQIDSNRSQENFQPAGLWRPLLKGPSECPSLLFCAHKCHPIAAA

SEQ ID NO: 791692 - protein, 311 aa, Homo sapiens
EGRGGAGKMAAPEKMTFPEKPSHKKYRAALKKEKRKKRRQELARLRDSGLSQKEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLLTDDGMQDDSCSVNSAP

SEQ ID NO: 791693 - protein, 139 aa, Homo sapiens
MEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLLTDDGMQDDSCSVNSAP

SEQ ID NO: 791694 - protein, 337 aa, Homo sapiens
GAGRCRQDGCAREDDVSRETKRSGELGQRCIVAADRRVYVLIFQPQKVQGRPEEGETKETSAGTCSTERLRTLTEEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRW

SEQ ID NO: 791695 - protein, 430 aa, Homo sapiens
GAGRCRQDGCAREDDVSRETKRSGELGQRCIVAADRRVYVLIFQPQKVQGRPEEGETKETSAGTCSTERLRTLTEEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKWRFVVYLKYNNVQEESTATFFMCSEIPTMNSGKLIETSTCLQIGLAPPLGRTPKGGRGWATTTTTTAGCGEEISQTHIKESGEAQFTKQRKK

SEQ ID NO: 791696 - protein, 34 aa, Homo sapiens
MWKMLTAAGSHQVAKSTASCGPRPKKHYLVFFLK

SEQ ID NO: 791697 - protein, 117 aa, Homo sapiens
KRKAIERTANQAVRLPRGSPRSFYYNSCHRVQKKEPRSLSSLLEENMKAAEGQKSHLVTSHRCSGGSLSHERVLTKRRLLFQSRTPAQQSRLGRKRLCPAFQFIPPSDFYNKKNLSA

SEQ ID NO: 791698 - protein, 126 aa, Homo sapiens
GWYCLGCSGLAGCRVPVAVGLCFLPLLPEAGFEVNSGPVWGGEAARCAQGPPRLLAPPAKEVGARVRAMGDNAAQGAVSSPGKTEASLYHQSRTCSGCGKRWPLLSKHFQGILAAEFPWEHVLVLR

SEQ ID NO: 791699 - protein, 110 aa, Homo sapiens
AALSRRGGSRVRPRTRPEGLRQLRMRTGWATPRRPAGLLMLLFWFFDLAEPSGRAEQTCGLVWGSTGILNPQPFGSIVWQECPLHDAGDGMHLVTCARLGLCRWPLLPKH

SEQ ID NO: 791700 - protein, 1583 aa, Homo sapiens
AALSRRGGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEA

SEQ ID NO: 791701 - protein, 1346 aa, Homo sapiens
AALSRRGGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRSKL

SEQ ID NO: 791702 - protein, 730 aa, Homo sapiens
AALSRRGGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFR

SEQ ID NO: 791703 - protein, 1746 aa, Homo sapiens
AALSRRGGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 791704 - protein, 1648 aa, Homo sapiens
AALSRRGGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVGMSVSPQGTHACLLLEF

SEQ ID NO: 791705 - protein, 770 aa, Homo sapiens
AALSRRGGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFHCI

SEQ ID NO: 791706 - protein, 86 aa, Homo sapiens
GIANQLRMRSHRPPSRNLQKAFQNRKTRKAAISRNSRAFRMRLSGVKGAVLHMQGSGQGCQALFIWERQAACLHLVWAPEGRAAPA

SEQ ID NO: 791707 - protein, 96 aa, Homo sapiens
PMGPSRLVRGPRPQGMRSPYRRPGMGWPRPRFPRMFKCSRRRYQQGLRGRTASSAAINPATRAMGINNTHTDTTIVWIFPPQVLRHLRQPGIFLIL

SEQ ID NO: 791708 - protein, 96 aa, Homo sapiens
YFDSGPPPAFSPPPPPGRAYDTVRSSFKPGLEARLGAGAAGLYEPGAALGPLPYPERQKRARSMIILQDSAPESGDAPRPPPAATPPERPKRRPRP

SEQ ID NO: 791709 - protein, 112 aa, Homo sapiens
HFYELLRTVTLTAKVCSFTPEARETTNPPEGMNNSRRTAFKSCNTYQRMSAASLLKSARPQTQQKEETPDTSEHLKEQTLDTPSLRTVTLTVRVNRFILEVSQTKNPPIPSI

SEQ ID NO: 791710 - protein, 819 aa, Homo sapiens
MDLGWDRSRGPRRSTSSVRVRELSWQGLHNPCPQSKGPGSQRDRLGEQLVEEYLSPARLQALARVDDLRLVRTLEMCVDTREGSLGNFGVHLPNLDQLKLNGSHLGSLRDLGTSLGHLQVLWLARCGLADLDGIASLPALKELYASYNNISDLSPLCLLEQLEVLDLEGNSVEDLGQVRYLQLCPRLAMLTLEGNLVCLQPAPGPTNKVPRGYNYRAEVRKLIPQLQVLDEVPAAHTGPPAPPRLSQDWLAVKEAIKKGNGLPPLGTAAAPGGPTAEPQLPPGRGPHPRLLRNGKPHLMHFSSLDPGPQSCAHPAPGQDTVSEQPTEGEEGLKMRASLEGCSVRGQPQAMQHGDWGPWSVDRVWGALSGWALVTSASEPRADCPRGAPIRRLDPELSLPETQSRASRPWPFSLLVHGGPLPEGLLSEDLAPEDNTSSLTHGNCLASKLTLQPLGPEPGPAMLSLAGAGQVLCGNPTKGLRERRHQCQAREPPEQLPQHRPGDPAASTSTPEPDPADSSDFLALAGLTAWREHGVRPLPYRHPESQQEGAVAPWGPRRVPEEQVHQAEPKTPSSPPSLASEPSGTSSQHLVPSPPKHPRPRDSGSSSPRWSTDLQSRGRRLRVLGSWGPGLGDGVAAVPVLRALEVASGLSPRAQGCPGPKPAHMQQLDLPGQLNSLTPAPSPLNIAPTARLACAGATTCPHMWSQSTEYLGGCVGGWKECLALGRTLLVEGSGGLGPAREAAEAGTQFRPPTGFGLGREGPAPQPFLRARLSRGHGGGGWSPEQACERPLLLELGMAEGQGLELRVHHSLASPRVRATS

SEQ ID NO: 791711 - protein, 819 aa, Homo sapiens
MDLGWDRSRGPRRSTSSVRVRELSWQGLHNPCPQSKGPGSQRDRLGEQLVEEYLSPARLQALARVDDLRLVRTLEMCVDTREGSLGNFGVHLPNLDQLKLNGSHLGSLRDLGTSLGHLQVLWLARCGLADLDGIASLPALKELYASYNNISDLSPLCLLEQLEVLDLEGNSVEDLGQVRYLQLCPRLAMLTLEGNLVCLQPAPGPTNKVPRGYNYRAEVRKLIPQLQVLDEVPAAHTGPPAPPRLSQDWLAVKEAIKKGNGLPPLGTAAAPGGPTAEPQLPPGRGPHPRLLRNGEPHLMHFSSLDPGPQSCAHPAPGQDTVSEQPTEGEEGLKMRASLEGCSVRGQPQAMQHGDWGPWSVDRVWGALSGWALVTSASEPRADCPRGAPIRRLDPELSLPETQSRASRPWPFSLLVHGGPLPEGLLSEDLAPEDNTSSLTHGNCLASKLTLQPLGPEPGPAMLSLAGAGQVLCGNPTKGLRERRHQCQAREPPEQLPQHRPGDPAASTSTPEPDPADSSDFLALAGLTAWREHGVRPLPYRHPESQQEGAVAPWGPRRVPEEQVHQAEPKTPSSPPSLASEPSGTSSQHLVPSPPKHPRPRDSGSSSPRWSTDLQSRGRRLRVLGSWGPGLGDGVAAVPVLRALEVASGLSPRAQGCPGPKPAHMQQLDLPGQLNSLTPAPSPLNIAPTARLACAGATTCPHMWSQSTEYLGGCVGGWKECLALGRTLLVEGSGGLGPAREAAEAGTQFRPPTGFGLGREGPAPQPFLRARLSRGHGGGGWSPEQACERPLLLELGMAEGQGLELRVHHSLASPRVRATS

SEQ ID NO: 791712 - protein, 819 aa, Homo sapiens
MDLGWDRSRGPRRSTSSVRVRELSWQGLHNPCPQSKGPGSQRDRLGEQLVEEYLSPARLQALARVDDLRLVRTLEMCVDTREGSLGNFGVHLPNLDQLKLNGSHLGSLRDLGTSLGHLQVLWLARCGLADLDGIASLPALKELYASYNNISDLSPLCLLEQLEVLDLEGNSVEDLGQVRYLQLCPRLAMLTLEGNLVCLQPAPGPTNKVPRGYNYRAEVRKLIPQLQVLDEVPAAHTGPPAPPRLSQDWLAVKEAIKKGNGLPPLGTAAAPGGPTAEPQLPPGRGPHPRLLRNGEPHLMHFSSLDPGPQSCAHPAPGQDTVSEQPTEGEEGLKMRASLEGCSVRGQPQAMQHGDWGPWSVDRVWGALSGWALVTSASEPRADCPRGAPIRRLDPELSLPETQSRASRPWPFSLLVHGGPLPEGLLSEDLAPEDNTSSLTHGNCLASKLTLQPLGPEPGPAMLSLAGAGQVLCGNPTKGLRERRHQCQAREPPEQLPQHRPGDPAASTSTPEPDPADSSDFLALAGLTAWREHGVRPLPYRHPESQQEGAVAPWGPRRVPEEQVHQAEPKTPSSPPSLASEPSGTSSQHLVPSPPKHPRPRDSGSSSPRWSTDLQSRGRRLRVLGSWGPGLGDGVAAVPVLRALEVASGLSPRAQGCPGPKPAPLQQLDLPGQLNSLTPAPSPLNIAPTARLACAGATTCPHMWSQSTEYLGGCVGGWKECLALGRTLLVEGSGGLGPAREAAEAGTQFRPPTGFGLGREGPAPQPFLRARLSRGHGGGGWSPEQACERPLLLELGMAEGQGLELRVHHSLASPRVRATS

SEQ ID NO: 791713 - protein, 105 aa, Homo sapiens
MRAKWRKKRMRRLKRKRRKMRQSPSKPLACCTVEATGAETWNARRWGCWYKLWDCMLLSRACLNGSRTSSPSDRRSPLRPTLLINKMPMLVLCPGPVTFWTISVF

SEQ ID NO: 791714 - protein, 177 aa, Homo sapiens
SVLPSAAPTTGQMKRIKKERKKRVQAQCPLPCPRLGEASTQVELRTNGDENRRGGFRAGEAPKSHSTEALTACVNPSCEYREKGCQASSTQGELRGHDGDMKSTLLNQLEMQPPLGLEDQGLLVFLAYVSEAWQNLHPWLLIDTGKARDKLVSIPVSDMRKFPSHQEQGLAHGLTFP

SEQ ID NO: 791715 - protein, 67 aa, Homo sapiens
PHTAADRGPLPTLVSPYELRKLRGLPSAPSCSLGCLYFQLGKGSGPQSTCPLSACTRPPCFPSNAVD

SEQ ID NO: 791716 - protein, 69 aa, Homo sapiens
VKRCQNPRRGSTNALPRRAVEELADGGTTEGSMGEQRQLQESGPNNHGNRTFRSTSSESHFLPVVGKGL

SEQ ID NO: 791717 - protein, 69 aa, Homo sapiens; identical to SEQ ID NO: 791716

SEQ ID NO: 791718 - protein, 134 aa, Homo sapiens
SRPLSKLLSLPHVLFSPEPAPFQLRKRTEDPMDSTLRQETPRGPCALTKRGTLFSGWLVSQTLGAQGHRTPGSRNQSGRKQVVEMAFLRTAVTHQPELKATCWPTGRDPDPHPSQEAPAQAVWGVAEGLLSLCR

SEQ ID NO: 791719 - protein, 407 aa, Homo sapiens
MRPPYLKIIRAIYDKPTANIILNGQKLEAFPLKTGARQGCPLSPLLFNTVLEVLARAIRQEKERKGIQLGKEEVKLSLFADDMIVHVENSIVSAQNLLKLISNFSKVSGYKINVQKSQAFLYINNRQRESQIMSELPFTIATKRIKYLGIQLTRDVKDLFKENYKPLLNQVKEDQTNGRTFHAHGWEEINIVKMAILPKVIYRFNAIPIKLPMTFFTELEKTTLKFIWNQKRACIAKTTLSQKNKAEGITLSNFKLYYKATVTKTACYWYQNRDTDQWNRTEPSEIIPHIYNHLIFDKPDKKKKWGKDALFNKWCWENWLAICRKLKLDPFLTPYTKVNSRWIKDLNVRPKTRKTLEENLGNTIQDIGMGKDFMTKTPKAMATKLKIDKWDLIKELLHSKRNYHQSE

SEQ ID NO: 791720 - protein, 106 aa, Homo sapiens
MALLHIALPRTSMWATLGCVWTCLPFHGWTSPDKRCGARRHRTGVTRLSQHCHLLAAGENAEFNRESTLVKDQLQKHTGRDPRTHIPTYTPQNRAPPTLARPQQHL

SEQ ID NO: 791721 - protein, 536 aa, Homo sapiens
AEEGAVAKGAGRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791722 - protein, 536 aa, Homo sapiens; identical to SEQ ID NO: 791721

SEQ ID NO: 791723 - protein, 569 aa, Homo sapiens
AEEGAVAKGAGRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGIPPHVKAPVSQPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791724 - protein, 449 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791725 - protein, 536 aa, Homo sapiens; identical to SEQ ID NO: 791721

SEQ ID NO: 791726 - protein, 316 aa, Homo sapiens
DWEEKRVLAICLASQSEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791727 - protein, 206 aa, Homo sapiens
WLTLEDTLPLLPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791728 - protein, 185 aa, Homo sapiens
RLSRGSLGPPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791729 - protein, 536 aa, Homo sapiens; identical to SEQ ID NO: 791721

SEQ ID NO: 791730 - protein, 351 aa, Homo sapiens
AEEGAVAKGAGRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKVRSKNSLDLQHHMFKFGAVNEV

SEQ ID NO: 791731 - protein, 111 aa, Homo sapiens
SGRGGGGKGGGTSVVLVARRSAWRPGRGGCEADELAALRLPRLPSCRRKGAASNKNPPHPVLSDSSDLRATYPPPPLAGAFDIVQQRNGYGEAQSAACRAGVCEAILYFAE

SEQ ID NO: 791732 - protein, 169 aa, Homo sapiens
MEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 791733 - protein, 536 aa, Homo sapiens; identical to SEQ ID NO: 791721

SEQ ID NO: 791734 - protein, 423 aa, Homo sapiens
AEEGAVAKGAGRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDKGLITRIYEELRKFYRKKKSNNHLKMGKRLDISQDKHGKTSVYGSVQHH

SEQ ID NO: 791735 - protein, 240 aa, Homo sapiens
AEEGAVAKGAGRPWSLSHVAAPGAREEVVVRQTNSRLSGFRGFRVVGGRGRRAIRTRRTRSSATLLTSARRTRRRRWLEHLTLCSKEMVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEV

SEQ ID NO: 791736 - protein, 94 aa, Homo sapiens
LSPGGRWLPVAHSDLRPPSCRQPPTARTEIFLPFFSFQALLKVLTRQIAMESEFKWPFKVDQLSEWLCLRRHRDLGQPVRDTPRSVYTALGLLF

SEQ ID NO: 791737 - protein, 102 aa, Homo sapiens
HFLNLSVSFAVSFILHSFCIGTFCWIPYFFFQGPISNTTPLKTFLHRNNLWCIYFCHLNEINGKIWQHKLFKVNLVIHIEETSICKRLLEIKPFKECIVNNY

SEQ ID NO: 791738 - protein, 159 aa, Homo sapiens
ARAAASPPVSLPPTGARLGHTAPLWLPHPLLFGLLTQPLNINSTPGKASWTILVPEGPSAKGRERGSGVVQGDTERGGHLGAEDAGTRSARKSRGSGVGGCGFQRNRRGCGRTRKEGVPERTRAAAGHKRCGTQEAVGSCGSPGHLDMDPPDLWLLQRP

SEQ ID NO: 791739 - protein, 93 aa, Homo sapiens
SRTGRAPRDTGTRRDMGDTEGHGGHGGRVLPSLGALAFLCLWSQESTPRADVRLLPMGPRAGMAQLLMALFFCVQDIKLPPIRSFNLFGAWIS

SEQ ID NO: 791740 - protein, 416 aa, Homo sapiens [sequence omitted]

SEQ ID NO: 791741 - protein, 122 aa, Homo sapiens
MGFHFCIWIIFLLPPPCKKCLSPPTMNLRPPKSCGNVFYWVLVLNSELLYKFCQTIKCRANWRPVRAPRGWNEATERHQERRTQMETEMGGISTTYWHRLCTCTDRRAEKLVMDGNNCWFHK

SEQ ID NO: 791742 - protein, 106 aa, Homo sapiens
LDPEIILQVFKRLFYMINAVTLNDLLLRKDVCSWSTGMQLRYNISQLEEWLWGRNLHQSGVVQTMEPLIQAAQLLQLKKKTQEDAEAICSLCASLSTQQIVQFLNL

SEQ ID NO: 791743 - protein, 267 aa, Homo sapiens
CLPAPSHHVGARGSLAAYPSLFVLAQEKVPCPSFTPMMPLSWFPPPFGPPRPPFWLVLGCQNGPPFWSPNFFPFPSKDPDVGAPIYFAFKQNFPFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIPNKTLEKLKSHVKIRNDLL

SEQ ID NO: 791744 - protein, 152 aa, Homo sapiens
MPSLCGVSLEDQSQGCCLTGEQQDSDLDVSDSGILSPNPDAFPASLDDLASLHPVPMPCPFSILEFLKPQWAVHSVLLWVTYDASLPPGPPANPRPLLIGVSLAGEQRAFWGCQVAALSAPVLARVAWLPETSCCLLAGGGPGHARTVSCSP

SEQ ID NO: 791745 - protein, 529 aa, Homo sapiens
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 791746 - protein, 466 aa, Homo sapiens
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGSFVKIGHIRACSEPRSRDCTPAWTTE

SEQ ID NO: 791747 - protein, 468 aa, Homo sapiens
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIDGVSLCYSGWSAVARSQLTATSASQVQAI

SEQ ID NO: 791748 - protein, 529 aa, Homo sapiens; identical to SEQ ID NO: 791745

SEQ ID NO: 791749 - protein, 120 aa, Homo sapiens
MVTSALKVQLSSHSPRRQDITVPDQPKGLHLPPSTQGALSASAGIVPVPTPASPAHRDRCSELIPGVTPHKGGGRWPGSELLPSWVGGFCPACRRAARGSCARARSVELQGGALGCLQAE

SEQ ID NO: 791750 - protein, 176 aa, Homo sapiens
MWFPRAPAGLRPGRVEGGGWKATFRPSWNHAAASRLPPTRQALPPVGTRGASTPSRPCAFRAGLLGKAAARGLEGPGSRLVPLWPPNRPAPRNWPTRAESPRSSKGARAGPPRPALGARLPEDPSESLRLPSRKWACSVSTPQRCPQWEGGPWTCREQSRGPWQRRTPRSQQPRGR

SEQ ID NO: 791751 - protein, 111 aa, Homo sapiens
MWASGSRDSMEAPGRKPSRASFQFPFGPRGPLLPNPKMSLPDTLRGNQPGCDALAQALPCLTSLPQPPCSWHIWSLAPVYSCACSTQRPLSSHLLSGGLRALGSRLPDPLS

SEQ ID NO: 791752 - protein, 120 aa, Homo sapiens
MSAPHCMALVRSLCLLGPHCVHSLLHATKHLPDVPAPPAPASSQGRRRRLPLLKGLFPMAPLRPLQETISPSQPRPFSPLPSPQALNGPATTLNSDLGQPSTGGAGGSVNSEGNSLTECQ

SEQ ID NO: 791753 - protein, 136 aa, Homo sapiens
MQSDIYHPGHSFPSWVLCWVHSCGHEGHLRETAEIRKTHQNGDLQIRGGRGRRESTEIFQVASVTEGEESPPAICMEVFLFLWFIAPIYACVCRIFKIQVRNTVKNSSTASLAPSISTSEERQIRIERHHYHLYGQ

SEQ ID NO: 791754 - protein, 73 aa, Homo sapiens
KHREKLLSGSESSSKKRQRKKKEKKKSGRYSSSSSSSSDSSSSSSDSEDEDKKQGKQRKKKKNRSLNQTVRIV

SEQ ID NO: 791755 - protein, 53 aa, Homo sapiens
MCVQAQGSRLHEEAELPCVPLSGRSNGGKAAVFTRICLTEASGAGGGGTSVLH

SEQ ID NO: 791756 - protein, 221 aa, Homo sapiens
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNL

SEQ ID NO: 791757 - protein, 102 aa, Homo sapiens
HLLTSRSGGDWARGAAPRVAGEPGPKRLPTVSGRRRAEVSLIRPSPRRSLASVSTSVHPPLHPPFHLSIHPTLGGRCPDARVRRGRCLEGSRAGPSFAAGAA

SEQ ID NO: 791758 - protein, 32 aa, Homo sapiens
CKEIVRFKDFFKLLTFNFLVLLNSAQKLQLLK

SEQ ID NO: 791759 - protein, 118 aa, Homo sapiens
IPTSPHRPSLQMGRPRPGAPRNSARPRARQWQSRRLLYALHPHPSRGSLFYSNLKVPPSAPNLPPTPRSAGKVNCGWRGIWGVWGAGRQGAGRMDVISGPELHSCPRAKRPFPAEVPN

SEQ ID NO: 791760 - protein, 145 aa, Homo sapiens
SQARKAEEKPWWDTAGDPGLAGLQQQGGPAAHWQRRELWDGKAAVNGQMQSLGQVFIALILGTSPGCPHGFTHRRALGYPKWAYPPCHSALPYPLTPIPAPSVAVHTLHRLGALCSQPVCQPTPQDTSSGADPWTCNNNKYFHNH

SEQ ID NO: 791761 - protein, 116 aa, Homo sapiens
MAPSLYGLRSGCLQGKAPLRFPAPYICGGGQRLQRHAAQPRQPVHADHVSVGLWGWGGKCWPSGRKRAVPQSFPRIESKVLRPGLLPPGASVPAEAKIGLSTFPAPILNRCVLDGG

SEQ ID NO: 791762 - protein, 204 aa, Homo sapiens
RGAECLLPWAALNLQGFQLLLLHPSATAMMDVSELGESARYLRQGYQEMTKVHTIPWDGKKRVWVPDEQDAYVEAEVKSEATGGRVTVETKDQKVLMVREAELQPMNPPRFDLLEDMAMMTHLNEASVLHNLRQRYARWMIYTYSGLFCVTINPYKWLPVYTASVVAAYKGKRRSDSPPHIYAVADNAYNDMLRNRDNQSMLIT

SEQ ID NO: 791763 - protein, 255 aa, Homo sapiens
SRPRPGRARALTESQQARARLPRVSSGSVVAATLGAESLRSRAAVESQRKEAQGAGEARSWTLLLPHLRDPHALRRGNDRHAATVGRGSHELRVSRGRGRGRRRQSRAGKARYPAPSAPTPPPRSWPRTPGLWSGRRGRRAASELDRTGAAGGSRAAEEVAFDGQRGVEIPSQRCDLLEPTLPLWWRGGSGPAPSRAWELNDPVCKAHLGDRKQPLPRLQFHTTCRYTSQNLRLGRPGPPEAKRVHFVISPGFSF

SEQ ID NO: 791764 - protein, 72 aa, Homo sapiens
SGLEPGKLIAIPKVTLMQEMGPMILGSSTPVAFAGYRLPPGCFHGLVMRKLKLREPKSFAQGDPALKGEASH

SEQ ID NO: 791765 - protein, 53 aa, Homo sapiens
KPETFSYVTLPKKEEEQVPERGLVSVPKYHFWEQKEDFTFVSLLTRPEVITAL

SEQ ID NO: 791766 - protein, 103 aa, Homo sapiens [sequence omitted]

SEQ ID NO: 791767 - protein, 116 aa, Homo sapiens
RQSLPAQTPFSRHQTLGSRLLLSPNNSLGGSPLAKAARASPWHSRRSPALHAPLRHPILPSCTQTPALPRPRAPDSPSSPVGRHPRPVWPQLPNLGPRCSPVYTRSPAPPAPRLRP

SEQ ID NO: 791768 - protein, 113 aa, Homo sapiens
DSHPCAQSSQAPTMAFSGRARPCIIPENGEIPRAALNTVHEANGTEDERAVSKLQRRHSDVKVYKEFCDFYAKFNMANALASATCERCKGGFAPAETIVNSNGELYHEQCFVL

SEQ ID NO: 791769 - protein, 113 aa, Homo sapiens; identical to SEQ ID NO: 791768

SEQ ID NO: 791770 - protein, 211 aa, Homo sapiens
MPDPPKFLLLLPQGAGRAQSAAPGALQPHKHAPAPGGGRAAGKDISEVSCGCNKLFKSALEHRCDLSFSILGQTAPETGNSPAPPHPTPQALLVGVGQGELSGMPGLSVQAWQPCPMGGADSVSHAPCPREEVGVPSIEMVKNKGGSDRLWDPVRSAFAGRKRLGHMERVINWKILGSSILKGDMIPWKGHELSCQFVLAFSNQCCVATAN

SEQ ID NO: 791771 - protein, 211 aa, Homo sapiens; identical to SEQ ID NO: 791770

SEQ ID NO: 791772 - protein, 71 aa, Homo sapiens
MGITAPQRYSSSPLRDPCSAMNSRFFLLSGDRDPVPSEGRVHPGLCSLPTAEPGELVAAVAPPPLLGANAA

SEQ ID NO: 791773 - protein, 887 aa, Homo sapiens
MLNSGRGTAKANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEGLMELNGSSSQLIIMLLKNFMLNQNVMLSVKGITKNVHTVSVEKCSENGTVDVADKLVTFGLAKNITPQRQSALNTEKMYRMNCCCTELQKQVEKHEHILLFLLNNSTNQNKFIEMKKLVKS

SEQ ID NO: 791774 - protein, 868 aa, Homo sapiens
MLNSGRGTAKANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEGLMELNGSSSQLIIMLLKNFMLNQNVMLSVKGITKNVHTVSVEKCSENGTVDVADKLVTFGLAKNITPQRQSALNTEKMYRRIAAAQSYRNKLKNMNIFFSSS

SEQ ID NO: 791775 - protein, 43 aa, Homo sapiens
PDSLRFPKSPLLLPWLLNTVTCLKAFLGVGWKNLDKVYHPRSS

SEQ ID NO: 791776 - protein, 152 aa, Homo sapiens
RVDNVSWGTIRLLQIPFFQFDLLLFDMLGLPLCNKSQRRPRTTGTFKQENKLAFRESKHLQKRKPHRSTVGLLLLPQVLLKLSPSVELPLSEQVEVIKAVKPGKAPPIFPCTEEGKIKVQKYGTRECGLCMASLDMNSVIIWVKQLTVQQES

SEQ ID NO: 791777 - protein, 104 aa, Homo sapiens
GPRTFRFQAIHPIAAPTWTNFQAEGEQQPQLPARGFPRVTAGLGSITRPLNGRTDDSFRRAASRTFQARICLPAVPLREAGGAGPGHICGARRPVWRFSYSVEW

SEQ ID NO: 791778 - protein, 141 aa, Homo sapiens
LSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKVSSDIHFRWHRVEKGINSFRAWSTSLQLK

SEQ ID NO: 791779 - protein, 102 aa, Homo sapiens
SIRVPFRHLATMHQHSRVQQGMRAPFQHPATMHQHSSVQQSVRAPFQHPATMHQHSSVQKSIRQHPGVQWHMCTWTFQCGELSGTEQGQRDKKMKVTQYSPL

SEQ ID NO: 791780 - protein, 234 aa, Homo sapiens
GPRPVLPRAAGVVGAGGRICAWPRVSVGVTHRPRPASASTRSGLKEARTRARAAWNAPRAAFHVFLGFSSFPPSSSNWICEHDELCFPELVLCLLFWPHLTEQNIKATEHQEGCCLGKLCEKSPGGLGAGQALLSLSWRLGRASRRLPGRRNHGQGLPHQDAFPTTEGFKPLVGESWINQDLSLLGGAEDRGHCEVSFSWVDSPGASEAGFRPCPLAAPLEALSIYPSGTLSLV

SEQ ID NO: 791781 - protein, 72 aa, Homo sapiens
MRFMDVAIEFSEERVAMTWTLDSTNYLIGTVNVKRTYHAKPGHAMECTAELNSYAQTTLTLTGRTATRAPDT

SEQ ID NO: 791782 - protein, 538 aa, Homo sapiens
MAAGGSAPEPRVLVCLGALLAGWVAVGLEAVVIWRSYENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLYYSPVFCWKVGNTSRGQNMDDVMVLVDSEEEEEEEEEEDAAVGEQEGAREREELPKEIPKQDHIHRVTALVNGNIEQMGNGFQDLQDDSSEEQSDIVQEEDRPV

SEQ ID NO: 791783 - protein, 114 aa, Homo sapiens
KPSSRAKVEEVGLPPGWEAGGIPLLLFSAGRSRLAGAGGGVRPPSPARALGSGDPSLQPSSAAGPGHSAQPSILPGGRGSGATLPFRGPGRSPRYPGPRGPGAHTSSPARACVS

SEQ ID NO: 791784 - protein, 517 aa, Homo sapiens
MIDKRDWRLLSFGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLYYSPVFCWKVGNTSRGQNMDDVMVLVDSEEEEEEEEEEDAAVGEQEGAREREELPKEIPKQDHIHRVTALVNGNIEQMGNGFQDLQDDSSEEQSDIVQEEDRPV

SEQ ID NO: 791785 - protein, 192 aa, Homo sapiens
RRRSALALAMERPAPGEVVMSQAIQPAHATARGELSAGQLLKWIDTTACLAAEKHAGVSCVTASVDDIQFEETARVGQVITIKAKVTRAFSTSMEISIKVMVQDMLTGIEKLVSVAFSTFVAKPVGKGFILREGKFDYNMKITFNNLMKESSKFDDLIFDEEEGAGFTRGTVQSIAGPPTPCPSRYIWWPDL

SEQ ID NO: 791786 - protein, 124 aa, Homo sapiens
PKDAIRALKKRLNGNRNYREVMLALTVLETCVKNCGHRFHILVANRDFIDSVLVKIISPKNNPPTIVQDKVLALIQAWADAFRSSPDLTGVVHIYEQPSAPESELLLSVHTSRLSRRGGRIFIS

SEQ ID NO: 791787 - protein, 136 aa, Homo sapiens
MKEDRFMLLFPLMCSHSVNLQIPCGAPREAGRKEPVPPRSPRRRGPRPRKRLVRPQLLSAAVVGGSWGASLDEGRCPAAAEALPAQPPSGAGTFGPEVHQPGRTPTFPQSACYRQRLLRRPKLTLQPPPGQERVAA

SEQ ID NO: 791788 - protein, 191 aa, Homo sapiens [sequence omitted]

SEQ ID NO: 791789 - protein, 136 aa, Homo sapiens; identical to SEQ ID NO: 791787

SEQ ID NO: 791790 - protein, 117 aa, Homo sapiens
MIFPCGAPREAGRKEPVPPRSPRRRGPRPRKRLVRPQLLSAAVVGGSWGASLDEGRCPAAAEALPAQPPSGAGTFGPEVHQPGRTPTFPQSACYRQRLLRRPKLTLQPPPGQERVAA

SEQ ID NO: 791791 - protein, 110 aa, Homo sapiens
MTHTEKTKHHHYRHCVNSLPATHTAQSRLCPCLCRPGLCLAAGDFISGCRSVCPCLLAGSSPAPGSQGAPWWGLCGPGPSLLPQGCEATGRPPRSLMLSVHCLYKYKESL

SEQ ID NO: 791792 - protein, 75 aa, Homo sapiens
ATGVTSQVLSSVPSRDVATVCQGSCCKGFQSLAPSPDAPALLRQRLCKSSPFSFPRLGLHPYKVSLQTPPSKPGF

SEQ ID NO: 791793 - protein, 111 aa, Homo sapiens
LIYKSSLYFKTIDAFIIIYCKHFFHFVICLFGLVMVFGIIHSCLVFIKSILSASSFITALVMFRKPCGEELLPPHLHPPHNAVKYLIQTCEIKLCTRGSPALLFTLIIASK

SEQ ID NO: 791794 - protein, 106 aa, Homo sapiens [sequence omitted]

SEQ ID NO: 791795 - protein, 108 aa, Homo sapiens
MPRMKYPCCSDSTDPSEVGHSLTNGILQRGSGSETDLVNGARSDRLLTRCGFSVDVPRTSSAEEEALLLTIFGRMTFCCCRSTRSPLLLCNLSLLFPFHLKLGCLCHR

SEQ ID NO: 791796 - protein, 77 aa, Homo sapiens
SSPPPHRADAGHFINPETVPKPCCAPTQLNAISVLYFDDSSNVILKKYRNMVVRACGCHSSSENSETYMILHRPKQV

SEQ ID NO: 791797 - protein, 168 aa, Homo sapiens
NPDDPDTVDVIMHMLDRDHDRRLDFTEFLLMIFKLTMACNKVLSKEYCKASGSKKHRRGHRHQEEESETEEDEEDTPGHKSGYRHSSWSEGEEHGYSSGHSRGTVKCRHGSNSRRLGRQGNLSSSGNQEGSQKRYHRSSCGHSWSGGKDRHGSSSVELRERINKSHIS

SEQ ID NO: 791798 - protein, 153 aa, Homo sapiens
AQSLPGVVVLPPAPRFFGGWPFQLQFCPGHNADDMVDTVLMNFLRGGWPGAGAWALRARGAPFRAAARCSSPRRRWCRTGTSAASTTSQKRGAPGTCSSAWRRRGRRRCWTSCTRPNAWRWPRPRGPRAPAPAPAVGRWPAARSARPAPSWTA

SEQ ID NO: 791799 - protein, 132 aa, Homo sapiens
ADSRVSLALVWPLVVGRVGRTGLPPLSLGLMTRARQLDTLDSEAPRFPSNSLTCLLSTSWPRFTFQLIRQDRAPFLQDSANLETPRAPGLGFLLLRHDPSFLIGGNRHHCEDFTSWLLACWEPLTRNQHPQQ

SEQ ID NO: 791800 - protein, 126 aa, Homo sapiens
MASVRANTYCRLLSLSVDNFNEVLEEYPMMRRAFETVAIDRLDRIGKKNSILLHKVQHDLNSGVFNNQQNAIIQEIVKYDGEMVQQAELGQRLGLFPPPPPPQVTSAIATLQQAVVMSFCPQVARP

SEQ ID NO: 791801 - protein, 261 aa, Homo sapiens
MAGQCLPTQGWVPSFPQIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 791802 - protein, 255 aa, Homo sapiens
MRGEDEAEHYKIPPLGKHYSQRWAQEDLLEEQKDGARAAAVADKKKGLMGPLTELDTKDVDALLKKSEAQHEQPEDGCPFGALTQRLLQALVEENIISPMEDSPIPDMSGKESGADGASTSPRNQNKPFSVPHTKSLESRIKEELIAQGLLESEDRPAEDSEDEVLAELRKRQAELKALSAHNRTKKHDLLRLAKEEVSRQELRQRVRMADNEVMDAFRKIMAARQKKRTPTKKEKDQAWKTLKERESILKLLDG

SEQ ID NO: 791803 - protein, 87 aa, Homo sapiens
KEKIDRCSGKRLGDGPKFLKSGDAAIVDMVPGKPMCVESFSDYPPLGRFAVRDMRQTVAVGVIKAVDKKAAGAGKVTKSAQKAQKAK

SEQ ID NO: 791804 - protein, 97 aa, Homo sapiens
MSVVVGPASSARDLPSPRGYTMTPQTMKVDEEVMAFRGAQCDGIRVLPSSMEDTPALKRAKSSKTQPTGDSWAGRLILSVDGSGFCERVKSLVVKQF

SEQ ID NO: 791805 - protein, 148 aa, Homo sapiens
THSFGEGGQDFSPEPLATRGVYISSGLIDDHRRPMALTPRHPRSGITAPRPRPQPPGRVGIPEPTALSPSPGPPPPPCSTPGRCQVPSLERRRKEGREPASVGRGCGGHGISPSSDIFFHLNFCLSHPPDLFVFVCSISNQLYIFHDP

SEQ ID NO: 791806 - protein, 110 aa, Homo sapiens
MARSWFTAASDLLGSSHPPISTSRIARTTGTRHQTREFIVQWKRKTQKSHNHSPTQNPCIGHCWSTGRVYFNLWVQDGVAKVLQKEVSLLGYGFFEKILLMGILDGHIMK

SEQ ID NO: 791807 - protein, 155 aa, Homo sapiens
EKCLKFGSRSHGPRGVLGRGHRGEGRGGGRCPEPRGGRDPEDEERESLRRRDRRDSETERQPRRQRRGDEQRRGDAERERDSEIDAQREQRRGELRTELRAGAQHSERGRARAGDSLAGWGRGAALPPAPSPLPPLPPAPPPPRSPPPPSTPLRA

SEQ ID NO: 791808 - protein, 138 aa, Homo sapiens
AEWHLSGPCRATLGAANRGRALGVRAAWRGAPLCQRVMMPSRTNLATGIPSSKVKYSRLSSTDDGYIDLQFKLIGAFLIIIGSLLLSGYISKGGADRAVPVLIIGILVFLPGFYHLRIAYYASGYRGYSYDDIPDFDD

SEQ ID NO: 791809 - protein, 162 aa, Homo sapiens
TALFAEIKLRVIRVGHSSPLAQLASFQKPVLFVLRLNSRRFLFLSLARSEDGEENNLCQRVMMPSRTNLATGIPSSKVKYSRLSSTDDGYIDLQFKLIGAFLIIIGSLLLSGYISKGGADRAVPVLIIGILVFLPGFYHLRIAYYASGYRGYSYDDIPDFDD

SEQ ID NO: 791810 - protein, 49 aa, Homo sapiens
MLQRTLTARVGLGLGLLPLGLALAAAQDELHGEALCPRSHANPVTAPTV

SEQ ID NO: 791811 - protein, 106 aa, Homo sapiens
GPLYMCSLRLQGHLLSAFSIASPSHILSPFIPVPLPKPLHFPEQRISPQTPLMSCGWHSFQWGCASSDLPRPGVTTVDKRDGTPSAMVEAIMPQRRVAEASQAGMH

SEQ ID NO: 791812 - protein, 120 aa, Homo sapiens
PSWLLVIFMITPHLHASPICLPALRMWPPGTRVYPEQIVVWAVASFRGKFRILAEPGSASCLLPLHVGCVEAPSPRGETLDVSLYKRAFTVSGLVFFFFFCFSKLISDIESCQSDCSLCG

SEQ ID NO: 791813 - protein, 178 aa, Homo sapiens
LIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGG

SEQ ID NO: 791814 - protein, 131 aa, Homo sapiens
MRSSALRKDTSEFLHGAHSALGLCIRKRKCPRALTPGLLGARNRPRGRGITHCLTVVCVHTAQAEREMTQSLDRGDSTQAGTAANTEMIKGSLPLFPLSQERGKRNLRGGVRFFCFVLFFKEQFHKLSINI

SEQ ID NO: 791815 - protein, 124 aa, Homo sapiens
PHNFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVT

SEQ ID NO: 791816 - protein, 124 aa, Homo sapiens; identical to SEQ ID NO: 791815

SEQ ID NO: 791817 - protein, 67 aa, Homo sapiens
GYPLQQLQLQQPQLQQLQLQQLQLQQLQLQQLQLQQLQLQQPQLQQLQLQQLQLQQLKRDKLMHNYS

SEQ ID NO: 791818 - protein, 113 aa, Homo sapiens
AWRAAVLGSLERARGQARRAGMAPGAGGPRATPRRLVGGAGVSRVGKRLPQVGRPMGEKTGLHRRLTEQVPPYVAGAPSEGRGRCAGGLYLGTWAHWHYLEDHVRGRYSGSCL

SEQ ID NO: 791819 - protein, 877 aa, Homo sapiens
QVPCAHLCLGMGRNRSWGTLGSGRTSTPGHQSGPLTRRRAVSQLYRRYLLFSISASDPSLRSGTQAPDIHLGEPARGTGCVRGKQTSIRVQDCGRREEARAASRELRREKAQEHPRESWAHPQPYPAPQPLALRPETQPCPACRSSPPGRLLLRPALPGHPFLLPIMAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 791820 - protein, 781 aa, Homo sapiens
QVPCAHLCLGMGRNRSWGTLGSGRTSTPGHQSGPLTRRRAVSQLYRRYLLFSISASDPSLRSGTQAPDIHLGEPARGTGCVRGKQTSIRVQDCGRREEARAASRELRREKAQEHPRESWAHPQPYPAPQPLALRPETQPCPACRSSPPGRLLLRPALPGHPFLLPIMAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQDGRGGIRDGEEGGDTPLLAN

SEQ ID NO: 791821 - protein, 75 aa, Homo sapiens
SHTFNHTNTHPAPKTLRPLGTYPDEHFTEEAPRRSIAAFQSRLAQISRDIQERNQGLALPYTYLDPPLIENSVSI

SEQ ID NO: 791822 - protein, 710 aa, Homo sapiens
MVVRERGNKFFLNAGVWKPMKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791823 - protein, 697 aa, Homo sapiens
MKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVAQTFSETSINFFPLTAAFCACQRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791824 - protein, 514 aa, Homo sapiens
MQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791825 - protein, 371 aa, Homo sapiens
GRPLARHARRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791826 - protein, 694 aa, Homo sapiens
MVVRERGNKFFLNAGVWKPMKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791827 - protein, 694 aa, Homo sapiens; identical to SEQ ID NO: 791826

SEQ ID NO: 791828 - protein, 694 aa, Homo sapiens; identical to SEQ ID NO: 791826

SEQ ID NO: 791829 - protein, 694 aa, Homo sapiens; identical to SEQ ID NO: 791826

SEQ ID NO: 791830 - protein, 694 aa, Homo sapiens; identical to SEQ ID NO: 791826

SEQ ID NO: 791831 - protein, 658 aa, Homo sapiens
MVVRERGNKFFLNAGVWKPMKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEGKLCPYQFTYVDIKVCKSQFMKAVMSPRKFRVVS

SEQ ID NO: 791832 - protein, 253 aa, Homo sapiens
MKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVVNTLLFLVSHLCLF

SEQ ID NO: 791833 - protein, 354 aa, Homo sapiens
MKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSR

SEQ ID NO: 791834 - protein, 334 aa, Homo sapiens
MKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRAESWA

SEQ ID NO: 791835 - protein, 262 aa, Homo sapiens
MKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVAQTFSETSINFFPLTAAFCHVRG

SEQ ID NO: 791836 - protein, 90 aa, Homo sapiens
AGLSPPSSSSSSSSSSSSSVVVVVGLPPAAAPPAAAAVPHRSSGHSLVSGSIMQANGAGGGGGGGGGGGGGGGGGGGQGQTPELACLSAQ

SEQ ID NO: 791837 - protein, 694 aa, Homo sapiens; identical to SEQ ID NO: 791826

SEQ ID NO: 791838 - protein, 732 aa, Homo sapiens
MVVRERGNKFFLNAGVWKPMKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVAQTFSETSINFFPLTAAFCHCQRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791839 - protein, 514 aa, Homo sapiens; identical to SEQ ID NO: 791824

SEQ ID NO: 791840 - protein, 451 aa, Homo sapiens
MKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 791841 - protein, 508 aa, Homo sapiens
MVVRERGNKFFLNAGVWKPMKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELTAPRTEPVSCRHARQLWPRNPHRQPLQTENTRCTVPTH

SEQ ID NO: 791842 - protein, 333 aa, Homo sapiens
MVVRERGNKFFLNAGVWKPMKNQLLAAAPPAAAAVPHRSSGHSLVSGSIMQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVRMKFLLLQQKYLEYLEDGKVLEALQVLRCELTPLKYNTERIHVLSGYLMCSHAEDLRAKAEWEGKGTASRSKLLDKLQSKSLNFLCCCVFS

SEQ ID NO: 791843 - protein, 82 aa, Homo sapiens
QLSWLQSGIGGQKASTAFSGPGTYQPNSMVTLAGPAGSSGDGKSKALGASPAKRGKGQARAGAQAGNQLSLHFLCGWRQTRR

SEQ ID NO: 791844 - protein, 100 aa, Homo sapiens
LGKRACVCTGNRPFWRWSGREGGVRLDLSACGETSGVAVSELPASETAALVPEGHGPGLRACALSLPDAPGASGGRHHLILVPVPFQLSLKWLYSSPSLG

SEQ ID NO: 791845 - protein, 100 aa, Homo sapiens; identical to SEQ ID NO: 791844

SEQ ID NO: 791846 - protein, 107 aa, Homo sapiens
MGRVSGLVPSRFLTLLAHLVVVITLFWSRDSNIQACLPLTFTPEEYDKQDIQLVAALSVTLGLFAVELAGFLSGVSMFNSTQSLICILSACPPFPHDPLLSGLPSAT

SEQ ID NO: 791847 - protein, 146 aa, Homo sapiens
MGRVSGLVPSRFLTLLAHLVVVITLFWSRDSNIQACLPLTFTPEEYDKQDIHPLPLCRLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 791848 - protein, 140 aa, Homo sapiens
MGRVSGLVPSRFLTLLAHLVVVITLFWSRDSNIQACLPLTFTPEEYDKQDIQLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 791849 - protein, 107 aa, Homo sapiens
MGRVSGLVPSRFLTLLAHLVVVITLFWSRDSNIQACLPLTFTPEEYDKQDIQLVAALSVTLGLFAVELAGFLSGVSMFNSTQSLISGTLGKEKPGLFLEIKACYKIK

SEQ ID NO: 791850 - protein, 100 aa, Homo sapiens
LGKRACVCTGNRPFWRWSGREGGVRLDLSACGETSGVAVSELPASETAALVPEGHGPGLRACALSLPDAPGASGGRHHLILVPGQQHTGLPASHVHPRGV

SEQ ID NO: 791851 - protein, 146 aa, Homo sapiens; identical to SEQ ID NO: 791847

SEQ ID NO: 791852 - protein, 182 aa, Homo sapiens
LGKRACVCTGNRPFWRWSGREGGVRLDLSACGETSGVAVSELPASETAALVPEGHGPGLRACALSLPDAPGASGGRHHLILVPGKTHGCLNPSPFPSLSGPSPTLPPPSVLPSWVFLFPAAPRPALQPAPFSLLFLCPAPRTATYRPACLSRSPPRSMTSRTFSELLGRGGQNEEVVGVEGS

SEQ ID NO: 791853 - protein, 107 aa, Homo sapiens; identical to SEQ ID NO: 791846

SEQ ID NO: 791854 - protein, 75 aa, Homo sapiens
MQVMLMWKVTAGGHQGQSVAQTSMWTRVPCPLWIAQSCLFSLQLQYSEEDCAFEEEIRPDGYNVYRSEKHRLPVS

SEQ ID NO: 791855 - protein, 216 aa, Homo sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 791856 - protein, 2111 aa, Homo sapiens
QGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENLIRITIYETVSVNEIQKGNVKTSTWLFETHTMDELRGEGLEYENIKTVTQEDVQKGDVKQAVWHFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKKWVPLPSLSTEKIKADFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFVRRNLD

SEQ ID NO: 791857 - protein, 2069 aa, Homo sapiens
QGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENLIRITIYETVSVNEIQKGNVKTSTWLFETHTMDELRGEGLEYENIKTVTQEDVQKGDVKQAVWHFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPEKKWVPLPSLSTEKIKADFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFVRRNLD

SEQ ID NO: 791858 - protein, 2424 aa, Homo sapiens
QGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENLIRITIYETVSVNEIQKGNVKTSTWLFETHTMDELRGEGLEYENIKTVTQEDVQKGDVKQAVWHFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKKWVPLPSLSTEKIKADFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLRELERMLNLGMLKQQKLPAIMKTQVLML

SEQ ID NO: 791859 - protein, 2111 aa, Homo sapiens; identical to SEQ ID NO: 791856

SEQ ID NO: 791860 - protein, 107 aa, Homo sapiens
THCNSKLIWEIMHHFMDKYTVNLTLNNFSNPKEIMMKVLDISSIKIDGTAKTKADQWTLFLMKNQICVKILQKTPLALHCDQNLNVHYDLQVQGCFLQYFYTYLVLH

SEQ ID NO: 791861 - protein, 1627 aa, Homo sapiens
QGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENLIRITIYETVSVNEIQKGNVKTSTWLFETHTMDELRGEGLEYENIKTVTQEDVQKGDVKQAVWHFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTEYTKLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFVRRNLD

SEQ ID NO: 791862 - protein, 76 aa, Homo sapiens
TDVDEMTGKFRTSTPILFFPFLQEGSRQPPCEEHQLWCSPDTSPTKSGGAGESPLTVSSIAFSMKKHGRLYPKALG

SEQ ID NO: 791863 - protein, 86 aa, Homo sapiens
VHGPSTSRPGLPPSSSPHVALCFFLLSPVQVGWAPPSPRGASPPPFRVSALEGVVFSPTSVPASRLELPRHAVGPISSPFRFHARS

SEQ ID NO: 791864 - protein, 423 aa, Homo sapiens
MIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPI

SEQ ID NO: 791865 - protein, 520 aa, Homo sapiens
INDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPI

SEQ ID NO: 791866 - protein, 204 aa, Homo sapiens
CPARRGGAYRGRQASLSCGGLHPVRASGLLCLPNQAWAMAGAPPPASLQPCSLISDCCASNQRDSVGVGPSEPGVGYNFVVRRFLSPSEKRSIRVGVTRFSRCCPSPLSLTRKGNSLTPCASQSEAMPRPALARARCAHPLTCARCLALPSEMNPVPQMEMQKSPVFCVAHAGSCRPELFLFGHLGSSLQELLNNIHTDPLWNY

SEQ ID NO: 791867 - protein, 154 aa, Homo sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAFSVATQTCQITPAEGPVVTAQYDCLGCVHPISTQSPDLEPILRHGIQYFNNNTQ

SEQ ID NO: 791868 - protein, 139 aa, Homo sapiens
AGVQGRDFVLLQYGGIPCRQCMMFSTRHLTNSSYLSLFLRQGLTLSPGLEGSGLISAHCNLCFPGSSDPPTSALQVAGATGVCCHARLILPYFVEMGFPHVAQAGLELLSSSDPPTLASQSAAISGISHPPKKYLIYRL

SEQ ID NO: 791869 - protein, 143 aa, Homo sapiens
AGVQGRDFVLLQYGGIPCRQCMMFSTRHLTNSSYLSLFLRQGLTLSPGLEGSGLISAHCNLCFPGSSDPPTSALQVAGATGVCCHARLILPYFVEMGFPHVAQAGLELLSSSDPPTLASQSAGVTGMSHHAQLSFIHLFKNIY

SEQ ID NO: 791870 - protein, 548 aa, Homo sapiens
MRKQGLFQWLDSLQIDNLTSPDLRLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMGHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 791871 - protein, 39 aa, Homo sapiens
ADTDNLGISLASITAQSNIVPTLGVQSLLFGVRPSWGLK

SEQ ID NO: 791872 - protein, 222 aa, Homo sapiens
MLIPKTMGKMSPGHVRGLDSSPSHHRPRGLGGKDDFMGQALGSPALCRLQTWYPAFQKLQPCLKEAKVQLGFWLQRVEVQGIGSFHGVLSLQGHRSQLLRLGNLHLDFKRCMEMPDDQAEVCCIGGPSWRTSARAVWKGNVGLEPPHRVPTVALPSGAVRRGPLSSRPLNGRSTDSLHCAPEKAADTQCQPMRAAGREAIPCKTTGADCPRLCEPASCISLT

SEQ ID NO: 791873 - protein, 594 aa, Homo sapiens
MVSHILQSELGDFHEETDRKHLAQTRYLPNQDCLEGKIMHFHQKHIGRSPAESDILLLDIARKLDMYGIRPHPASDGEGMQIHLAVAHMGVLVLRGNTKINTFNWAKIRKLSFKRKHFLIKLHANILVLCKDTLEFTMASRDACKAFWKTCVEYHAFFRLSEEPKSKPKTLLCSKGSSFRYSGRTQRQLLEYGRKGRLKSLPFERKHYPSQYHERQCRSSPDLLSDVSKQVEDLRLAYGGGYYQNVNGVHASEPVLESRRRNSALEVTFATELEHSKPEADPTLLHQSQSSSSFPFIYMDPVFNTEPNPNPDPRDIFSERSSLSSFQTSCKFSGNHMSIYSGLTSKVRPAKQLTYTDVPYIPCTGQQVGIMPPQVFFYVDKPPQVPRWSPIRAEERTSPHSYVEPTAMKPAERSPRNIRMKSFQQDLQVLQEAIARTSGRSNINVGLEEEDPNLEDAFVCNIQEQTPKRSQSQSDMKTIRFPFGSEFRPLGPCPALSHKADLFTDMFAEQELPAVLMDQSTAERYVASESSDSESEILKPDYYALYGKEIRSPMARIRLSSGSLQLDEEDEDAYFNTPTAEDRTSLKPCNYFLA

SEQ ID NO: 791874 - protein, 96 aa, Homo sapiens
SSDSHLWNENHPPQVVMQDKGGQMGIPTSRKPPGFIPLGLSECRALGNELTFALFVWHPPRDNTLNPGNNLARQVYPAPVSVEHTGAGAGWQFAQS

SEQ ID NO: 791875 - protein, 108 aa, Homo sapiens [sequence omitted]

SEQ ID NO: 791876 - protein, 119 aa, Homo sapiens
CPSSPVCHQSVMVEAGLRLRSSEPYSRSFAFMLALLPRYTMGVIWCLPSPGTLFFYLEQLLREENGVLGMCPFPIALKDALCQVPWTFHRLVLGKSICQQVTILAFNSELRYFVLSAVK

SEQ ID NO: 791877 - protein, 63 aa, Homo sapiens
MSGDPSGHVSKTEHLQPTKRLPSALPSPKLTQSLGSCELHLKACTSRSRGVGAAEIDEAHPDE

SEQ ID NO: 791878 - protein, 169 aa, Homo sapiens
MRTQGEDVHLQVKERGLGENQPRRHLQLQPLASRTVRKCLVYKRSTQAPVLQMRRVMTRKDKAPPFWRSESPKCVPPTYTAPAKGDSRGTHKMTLHFFPFLKSKSQNWRNLSASTQSPPSQAMGSNRTRHSMAVSMLSRENKGMLGASQTSRARAPPGGLVRQQVCGRA

SEQ ID NO: 791879 - protein, 107 aa, Homo sapiens
MAGEDVGAPPDHLWVHQEGIYRDEYQRTWVAVVEEETSFLRARVQQIQVPLGDAARPSHLLTSQLPLMWQLYPEERYMDNNSRLWQIQHHLMVRGVQELLLKLLPDD

SEQ ID NO: 791880 - protein, 136 aa, Homo sapiens
LWGRGGGSGRAAGARGRALGHGGGARPAAPGKRPRGLGQAWPSGRRAVAGRGPGVRPGGGGGREAALWGRRRTYSVSGARAPGQAPPEYRRPFCPPAKETRARPTRLGDSPLRRHLRERRPLEPGGRSFESQSQNS

SEQ ID NO: 791881 - protein, 68 aa, Homo sapiens
MTNLVAGNPTKNHAPFSVSIWAVNFHPLLECTTLGLREEWGRTLCPHHALATAPTTLRDTRHRLSQST

SEQ ID NO: 791882 - protein, 136 aa, Homo sapiens; identical to SEQ ID NO: 791880

SEQ ID NO: 791883 - protein, 110 aa, Homo sapiens
GGGRQPLRLGTRPGLSSGRRAVAGRGPGVRPGGGGGREAALWGRRRTYSVSGARAPGQAPPEYRRPFCPPAKETRARPTRLGDSPLRRHLRERRPLEPGGRSFESQSQNS

SEQ ID NO: 791884 - protein, 136 aa, Homo sapiens; identical to SEQ ID NO: 791880

SEQ ID NO: 791885 - protein, 108 aa, Homo sapiens
CQQNQQQCQPPPKCPPKCTPKCPPKCPPKCPPQCPAPCSPAVSSCCGPSSGSCCGPSSGGCCSSGGGGCCLSHHRPRLFHRRRHQSPDCCESEPSGASGCCHSSGGCC

SEQ ID NO: 791886 - protein, 155 aa, Homo sapiens
MQPSPPPTELVPSERAVVLLSCALSALGSGLLVATHALWPDLRSRARRLLLFLSLADLLSAASYFYGVLQDFAGPSWDCVLQGALSTFANTSSFFWTVAIALYLYLSIVRAARGPRTDRLLWAFHVVRWVAVALLFQEPPTQADPSRSCPPRGRV

SEQ ID NO: 791887 - protein, 121 aa, Homo sapiens
MCWDASKTLCLGIRSSGILCIPIQNPKENDFIEIELKRQELSYQNLLNVSCCELGIKPERVEKIRKLPNTLLRKDKDIRRLRDFQEVELILMKNGSSRLTEYVPSLTERPCYDSKAAKMTY

SEQ ID NO: 791888 - protein, 154 aa, Homo sapiens
MGRRSPFKPRNKVFGFSYPWCRSYQPFPRKRAWPPSRVWLGACCASLASPPKGTIPSGEYYRPAPSSSGDSLRRESGALLQYLPSLASPCANHATRCSLLFPIYKIKMTLLYLTGLARTHCCCLADRCAEAVESAFYLVGSLCINARGAAHLTD

SEQ ID NO: 791889 - protein, 208 aa, Homo sapiens
AYHPFRRLAILPASAPPATSNPDPAVSRVMNMSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATR

SEQ ID NO: 791890 - protein, 30 aa, Homo sapiens
LSEKVRVPVCPLPAPSFPSVAVNEPVSVLT

SEQ ID NO: 791891 - protein, 340 aa, Homo sapiens
APSRSQAGECQFWHQPSCSLLGPLLPHLSGVESEKARHQGGTCALLHILPPAARRACRPRPPRLWSLPLCCVFMSLRVLGSGTWPSAPKMFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 791892 - protein, 122 aa, Homo sapiens
GLEEWSSLLSLLIHASSKERAQLGQHTMQTLLPAHLTTPAPGCAHSPTRCRHCSRPTSPHPPLAAPQSHPMQTLLLTHLTMPAAGCAHSPTRCRHCSRPTSPRPPLAAPTVPPDADTAPGPP

SEQ ID NO: 791893 - protein, 132 aa, Homo sapiens
MNDAEDGRFLHFQLRYQVHLTGACQTNRCSPWSRAGHRLTWEAQGVGEFPLLQKGSRERLHLENRDTPTLILHFSNGLSKRLTRRLYPAPGSEGPMPKEPCSLLAQQSEIKLQGDSEAEGGASAIAEARVHK

SEQ ID NO: 791894 - protein, 105 aa, Homo sapiens
KRGEHQWSPKALEDKTEAPSDSRATQPACSFSLSAEKISDFLTVATFIMWILAPASLVDTDSADLFARPSNPDCPCTYPPPSDIDHETRSPTYNSPSPFRINNNC

SEQ ID NO: 791895 - protein, 113 aa, Homo sapiens
KRGEHQWSPKALEDKTEAPSDSRATQPACSFSLSAEKISDFLTVATFIMWILAPASLVDTDSADLFARPSNPDCPCTYPPPSDIDHETRSPTYNSPFTILAESPSPFRINNNC

SEQ ID NO: 791896 - protein, 141 aa, Homo sapiens
TVLNIYAPNTGDPKFIKQLLLDIRNEVVGNTIIVGDVNTPLAALGRSPRQKVNKETMDLNYTLEQMDLTDTYRTFYPTSIEYTLYTSEHGTFSKIDHMIGHKTSLSKFKKIRIISSTLSDHSGIKLEINSERNTQKHANTW

SEQ ID NO: 791897 - protein, 255 aa, Homo sapiens
ASAFAEHPGHVSFGPGELLQLGEPRTAREEVGHFGVLGQHRVHRVPAVVAAVHGAGVAPPGRPAVLLRRRVERLELDLEDERLSERHESPAPYPESKVKSSSVFRVELYVPAMGSLPRAASPSEGHSQLHALFPKWAETSSRPSGPPSFLSASRGSAAALPARRPREGGRDPWPAGAPRSRRPDSQLPLERTPSLPPGTPPCPPLIPTSRESVLHREGIPGEQGGGGRRRRRRRRAQGAARVRDQPARKRSLVPT

SEQ ID NO: 791898 - protein, 73 aa, Homo sapiens
NTCVILNCIVFMTFPVFIWLADECKMPFSFMEGTHESWLCDKQKKPRFGGFLVCVRVHLHVCGHTLVPNGPPV

SEQ ID NO: 791899 - protein, 100 aa, Homo sapiens
EGGYPAYASGGGYVIAGRLAPWLLRAAARVAPFPFEDVYTGLCIRALGLVPQAHPGFLTAWPADRTADHCAFRNLLLVRPLGPQASIRLWKQLQDPRLQC

SEQ ID NO: 791900 - protein, 514 aa, Homo sapiens
MALLLLLFLGLLGLWGLLCACAQDPSPAARWPPGPRPLPLVGNLHLLRLSQQDRSLMELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGSEGGCGGCSCAPLGRSPPLPSRSRPGAAHSVPGHPPQAAASVLGSAWPGPSSSCCLPASCRGTACCPRLASVRPPWTPRPPGLLP

SEQ ID NO: 791901 - protein, 464 aa, Homo sapiens
MALLLLLFLGLLGLWGLLCACAQDPSPAARWPPGPRPLPLVGNLHLLRLSQQDRSLMELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGQQPSGPGWGGTSRAPGVGRPQLRLPPLHPPPDLRF

SEQ ID NO: 791902 - protein, 263 aa, Homo sapiens
ASTRPSQGETTLPAGGARQAQSPPGRWRLHGTAWSGAAPGQQSIPWPSLLVPAPYHRDAAWNSLLAIADAPGRRVARGVAGLPQAVTEHPLVPGSPLRYSLVGWLSGGPDSPRSEVCSVFHSMTHRRFKVTSTVAAASLLPLQDGRRSCCANLPGCPLPGHGQGVSWQFLVLPGGLRVPPFCGRLQHIHPESLGVNTAAGDDHRLPSVQPWGCVLISAPPASAQLFNVYPWLGALLQLHRPVLRKIEEVRAILRTLLEARRPH

SEQ ID NO: 791903 - protein, 136 aa, Homo sapiens
LLSRSPRSSLALPVALSPFRILVPTLPFPWSASRVSRTPAPTPFPNLGLRVLSLFFPLPAPARGLRGPAPLCPAHLEAPAAQLGAGPARSPTPREPRAARSWRGGARPRGRWPGSRRREESGGRLQAGGGRREAAA

SEQ ID NO: 791904 - protein, 90 aa, Homo sapiens
MGGVERENQEARDQAGEGRRVSPLAPALLGARPIPQAWPTPGPSVRSRGSQGRIPRPSRQARGSSRPSTPAGRRSHAPPIMGAPEGGREA

SEQ ID NO: 791905 - protein, 134 aa, Homo sapiens
FQQGPGPCGAPVGPVRLPSRAFLKGRVSPAVCVRVRVRACAGGGVCKTPASPPSLHPQAAGPRGSNSRCPAGHTPPRGSGLGTKALATPRQRNGPLPSHPRPREAPREDADRGCWLCCLAPRLLSARREHSAGG

SEQ ID NO: 791906 - protein, 135 aa, Homo sapiens
EETRRKPGWRSSAGPRSLGGQHPGRRRPRPQPERPAGGRSRAHEGASAGREPGERVALSFPGLHSGGSRGARSRSEPGAAGGGGLGRGWGELVVGGGGCVWVGGGVRNGGAARQRVHFPGNQQQAAIFRECCPFN

SEQ ID NO: 791907 - protein, 120 aa, Homo sapiens
IFFKMKGETQSCYAAQASLEPLTSSNPPVSASQVSGITDTSNKKTEPPGRCYKQCELVLEEERIHQCPGPSKASLRERHLDRDAKDKEEAGHPPLGKVQKPKIHVHVLQAQKEDPVAGVE

SEQ ID NO: 791908 - protein, 88 aa, Homo sapiens
FAHAVLLVATASMSYRRERRLGTAKAPHGYTLVERLPPWKGHLNHFLLVPLQTFQTLSPIQRWLSTDYMSNQQANPLGAMKKHEATAT

SEQ ID NO: 791909 - protein, 127 aa, Homo sapiens
MGCSEDPPSDTSSIDTVSTAWGSQTGGQLEGWLTCCRRRLSHRGNSAPHGNVRTLTPCQRLPHSECTCTSAKRIPAHVLTNPQTPIAPWMSTLEWSIRRAGDLHQKQGVIISVHHIWGLWSWHKLNS

SEQ ID NO: 791910 - protein, 68 aa, Homo sapiens
AYWAYGGNCGVYGGNRGVWRKLGHTEETVGRTEEIEAYGGNWGIRRKRGCTEQTVRHPSEPSIVSVNT

SEQ ID NO: 791911 - protein, 131 aa, Homo sapiens
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERVLLCLPGWSAVVRSRLTASSASRIRAILLPQPPQ

SEQ ID NO: 791912 - protein, 101 aa, Homo sapiens
SDELSIVPGTSRCSIFYTHFSWPYNIPVYETLQLVHPIPYHSFVLDTPSGSRGSKDAAMVRVSPSTLPANPSSPNEVNFLCWGLRMQTPVSEQAQVQIPWP

SEQ ID NO: 791913 - protein, 107 aa, Homo sapiens
MAGKQINEGAAIDLNNRPPARSPALKFLRDPHPSWFVDLKVEAALQPFPPERKEAAPKSVLAPWPSCSFEGGGNRCFNPLFRRIWNEHFFFGGWGLFVPLNVLKQIS

SEQ ID NO: 791914 - protein, 103 aa, Homo sapiens
PHTPPPPPPSAAMKPRHPRGLGGRMLAGRALETRRTGSSPRSPVSQGDWGAPRHAESRCKSREREHLLAESTRGAPCPGPRAPPQFPGSCRRALADASSAPAA

SEQ ID NO: 791915 - protein, 132 aa, Homo sapiens [sequence omitted]

SEQ ID NO: 791916 - protein, 160 aa, Homo sapiens
QAGGESPGAHGARAPSGTLPRPWAGPVGAGSPGSVRRAGPGWRAAPGPRQLEKEPEPGRDEKVTPPGAPLALWGKMLAYCVQDATVVDVEKRRNPSKHYVYIINVTWSDSTSQTIYRRYSKFFDLQMQLLDKFPIEGGQKDPKQRIIPFLPGKILFRRSQ

SEQ ID NO: 791917 - protein, 164 aa, Homo sapiens
MDPGNPGSSPRCASRPLGLPRSRQKAHERKVRHLGQRKKKNRACRKAGPGSSTDEGAFPSAPALGPGEPGVPGWKPGYTLDPLGVPQGEQKAHEGKVRHLRQRKKKNRAAEKRGLGPPLTKVSFRQPLSWVPRTLTSLVRAHAAPQAATSTPRRKEGPKVSAEV

SEQ ID NO: 791918 - protein, 79 aa, Homo sapiens
LRAVPMLALRVALVRVVLLQVAVTAHLVLGPRDAGLARGHAPPQLLLHPQVGDRGGHQRHKQHRQLSLGVRRGMPGTRG

SEQ ID NO: 791919 - protein, 178 aa, Homo sapiens
MLILGIFILGIFRCQSGPRTSTSGALISTLGPLISKSGTCMSPSTFGRDTSISPFTLGPFRLRSMSGMEILGALMFISGILNLGPFNFPSGPSIFTSGTSMSTLGPETSRSALGKFTSTSGPSTLKPGMLNLGIFTLGIFRCQSGPVNINISINVHFGALDVNFMTLEVTLLPNFHEV

SEQ ID NO: 791920 - protein, 265 aa, Homo sapiens
CCVPPRIHPRSSIPGYSRSLTTGQLSDELNQQLEAVCGSVFGELESQAVDALDLPGCFRMRSHSYLRAIQAGCSQDDDCLPLLATPAAVSGRPGSSFNVQKGPGTLNPSRGQPWAPAPHSPLEPARARHPTSGARRGFHRLRPKVAPPVPGQPRQRDPDPEQTAVYRDISHKWGLPAQQRERSGPHRVHEPTGEQVTKEPQHTEINTTSQENQVPPRKPGRDPPGQKPTGPTGPDWASLVRSGPPHRRGAKVEHHPTCQKSSDPP

SEQ ID NO: 791921 - protein, 734 aa, Homo sapiens
MHWEPGEREQPQLSDELNQQLEAVCGSVFGELESQAVDALDLPGCFRMRSHSYLRAIQAGCSQDDDCLPLLATPAAVSGRPGSSFNFRKAPPPIPPGSQAPPRISITAQSSTDSAHESFTAAEGPARRCSSADGLDGPAMGARTLELAPVPPRASPKPPTLIIKTIPGREELRSLARQRKWRPSIGVQVETISDSDTENRSRREFHSIGVQVEEDKRRARFKRSNSVTAGVQADLELEGLAGLATVATEDKALQFGRSFQRHASEPQPGPRAPTYSVFRTVHTQGQWAYREGYPLPYEPPATDGSPGPAPAPTPGPGAGRRDSWIERGSRSLPDSGRASPCPRDGEWFIKMLRAEVEKLEHWCQQMEREAEDYELPEEILEKIRSAVGSTQLLLSQKVQQFFRLCQQSMDPTAFPVPTFQDLAGFWDLLQLSIEDVTLKFLELQQLKANSWKLLEPKEEKKVPPPIPKKPLRGRGVPVKERSLDSVDRQRQEARKRLLAAKRAASFRHSSATESADSIEIYIPEAQTRLLTGPARPARPGPAVLHPYCTPSVEVTVNAGRPVRPPHRHRTPRPPGPSHSRGFFTFLIPREGARAGQGAVPLRPAPLTWIPCPPGPTLCPHLLPMGTISAILSPTGQAGPGPSSGLCVPPSPTPRGWASWGSSFVAFYEESRTLPRSPPHPPRGSILSPLPTGPRDHSGWTNPGPGRLGLSPFPAAGEGRWGLPLTTPVAVPTSP

SEQ ID NO: 791922 - protein, 108 aa, Homo sapiens
GIARGSCSLFLIERFLVPNPQLTNYDYFHYCTFIEHLSIDKFQSDFISPSVGKGIEARVVGRVPGWEAGIDTLAPFLDPSLCLRPVVQSRPQARVCAGVRTASRFKNK

SEQ ID NO: 791923 - protein, 170 aa, Homo sapiens
GVSLLLPRLECNGAVSAHCNLCLLGSSDSPASATQVAGITGACHHAWVIFAFLETGFHHVTQAGFKLLTSGDPSRLGLPMCWDYRHKLLTQPNPTLISGFNGQNCFLVQKEKVCHQEQSPSTSQPCSTNLFVPAPEEAPPLLCKGMCTHLGPGSHCSSSSRTGALQLECA

SEQ ID NO: 791924 - protein, 139 aa, Homo sapiens
LGNPYCSPTLVRKKAIRSKVIRSGAYRGCTYETQLQLSAREACELWEHACPVCTWDSARALLDQPEVGVSARSCKAVAAPPSDACALCVFACIRVCAKGTVYSRVWTRTVGRKARVQICLLSRVERLGEDTTLGDEACG

SEQ ID NO: 791925 - protein, 225 aa, Homo sapiens
EIGEFWLILSLVHIPTSSKVPGPVPPPGVSVHLREWQEGIGRSRPRSGARGWDPASRAPTGDRKPVFKQVESSVSPELKERVNPSRLDSEFCVLPLTSPPSAFGVPFLALQTLRACSREDETGGSRAAGRVRYELLRGVGRGAGEGRVSRGPWMGEPGARGAPRQAVQASRCWNKGCGAARLPRPLMGKDVSSWGSSFACKSSAGPLFFVGKQKDVCVFVGTKPA

SEQ ID NO: 791926 - protein, 119 aa, Homo sapiens
KCQQSICQRSPCFCLQMRVPRGIVSNGRLSPTFSPLFSFLDTVHIHSRVPFFLPPPLLILLRRIFISNAQCLGFSLGSFSPDLRRFLYTKMYGSGTFVTIIVITIYTFLFFNNYCFNFC

SEQ ID NO: 791927 - protein, 88 aa, Homo sapiens
SKVFFHVSETEKGRKRRRKGRGKGKRKEENELQLRKWKSEKRFQIPDLTGGFLGLLKKKKKEKEKEKKKRSVINKKKTYLGAMNTLNI

SEQ ID NO: 791928 - protein, 121 aa, Homo sapiens
QAEQIPENKRGRRPDKGGEGVSLFLPCTATLTPSMPPQQQEGRQGFQTGGNECISGMHGLPGTAVPPKPTFHRGALPGSSHSWRCHLSFIDPDSWHQSPPPLHPQQKPEGSCIPSFCQSGS

SEQ ID NO: 791929 - protein, 80 aa, Homo sapiens
NPLQVQARVASAFLVRHTATQTEHPLLPHSPQAAKSSQETFFSPLKAVHLGLVSPAEKWVMADRGRSGSLRQSPLLHSAI

SEQ ID NO: 791930 - protein, 154 aa, Homo sapiens
DSADQMLTSYPSERKRHKVWYKKFFHHLLHITVLNSYILFKKDNPEHTMSHINFRLALIERMLEKHHKPGQQHLRGRPCSDDVTPLRLSGRHFPKSIPATSGKQNPTGRCKICCSQYDKDGKKIRKETRYFCAECDVPLCVVPCFEIYHTKKNY

SEQ ID NO: 791931 - protein, 105 aa, Homo sapiens
RFHYSCRRFSVGLMPPARLSIYLLLIWIQWGHFSGQRVGALKGPWGALKEQHGGLSGEPESVPSSKPWVGPPHCHRICNTCCHDKEEKNSTQRTEYKADLEGKEL

SEQ ID NO: 791932 - protein, 70 aa, Homo sapiens
MAPEEDAGGEALGGSFWEAGNYRRTVQRVEDGHRLCGDLVSCFQERARIEKAYAQQLADWARKWRGTVEK

SEQ ID NO: 791933 - protein, 119 aa, Homo sapiens
DGVLVCCPDRSAVVLAHCKLHLPGSSDSPASASQVAGTTGTCHHTQLTFVFLVEMGFHHVGQADLKPLTLGSALLGLPKCWDYRWEPPCPASLTSFLCLRLNSAIRWLTIWLSKSSPPK

SEQ ID NO: 791934 - protein, 141 aa, Homo sapiens
PHSTLLRLIRVDRSRCGSSGICWCELRGGVPHQAPQRAPLGSSHRPLLGLAGGFPRRPLRRGCSSPLDLWDSPSVSGMTPLLVIWVADIPSVSVACLAALFMVRFCHADVSNFALSGLGNLSVRDLCFWCLCTNSFPVQKA

SEQ ID NO: 791935 - protein, 101 aa, Homo sapiens
QAMDAGLGPICTCQCPSRQQQRPAAVMRGVATALVLEGKHLPRSPLTPAPVEAEGKGRPKRRPPHLAALPCTHVQAPPSALSESCGLKPKNVTCNGARFTK

SEQ ID NO: 791936 - protein, 551 aa, Homo sapiens
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYHQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPGIQNLARRGGACLQFQLLGRLR

SEQ ID NO: 791937 - protein, 564 aa, Homo sapiens
MAEGEDMQTFTSIMDALVRISTSMKNMEKELLCPVCQEMYKQPLVLPCTHNVCQACAREVLGQQGYIGHGGDPSSEPTSPASTPSTRSPRLSRRTLPKPDRLDRLLKSGFGTYPGRKRGALHPQVIMFPCPACQGDVELGERGLAGLFRNLTLERVVERYHQSVSVGGAILCQLCKPPPLEATKGCTECRATFCNECFKLFHPWGTQKAQHEPTLPTLSFRPKGLMCPDHKEEVTHYCKTCQRLVCQLCRVRRTHSGHKITPVLSAYQALKDKLTKSLTYILGNQDTVQTQICELEEAVRHTEVSGQQAKEEVSQLVRGLGAVLEEKRASLLQAIEECQQERLARLSAQIQEHRSLLDGSGLVGYAQEVLKETDQPCFVQAAKQLHNRIARATEALQTFRPAASSSFRHCQLDVGREMKLLTELNFLRGCGHRGLCSGAPPVPEAPVIDTQRTFAYDQIFLCWRLPPHSPPAWHYTVEFRRTDVPAQPGPTRWQRREEVRGTSALLENPDTGSVYVLRVRGCNKAGYGEYSEDVHLHTPPAPGIQNLARRGGACLQFQLLGRLR

SEQ ID NO: 791938 - protein, 133 aa, Homo sapiens
MNSAVTSEDSCSKCLIMRRCAGLRRLCDVCTVRKPAFLLLSNLGSAFWNFSALIFPHTPLTATTYHHHNPKQSKQTESLNKNLHLGKRFYSSRVEFLFIPIIDSQLQKSVKSYFGHGSCKKPYLQTFYFKEGI

SEQ ID NO: 791939 - protein, 70 aa, Homo sapiens
RCGGSGCGEQRCLPPGFICKFPSLQKSGMPTDGAPTSAPSPGLPLSELLMGFSQGSACCLYSGGISRPPG

SEQ ID NO: 791940 - protein, 141 aa, Homo sapiens
KHFLMVHLCVSSPGLGWRSPGEVQVPPSQPGPTLSTTHSPFCGQTTSPSPSWKRLLGPPTLRSPATLSTDETTGFTNLSSDSLDTLIPFWSFFPLPFLRHYSIGPLIIINSVSLGCGGRIKINYLTYFISIHFCWLLLLLQ

SEQ ID NO: 791941 - protein, 129 aa, Homo sapiens
EGKVSGCQESQRAEQGEETRRRVRRRQHGIPPSGLSGRCWWGIKMNTLQTRTRAPQELFVPPETSGPTSEKMLVSFHGSSLRNEATPQYGLEEEAGNGRWQQSLSLECWPLWTSHPFGTPSLMTLAVER

SEQ ID NO: 791942 - protein, 67 aa, Homo sapiens
WQCLGVKALRLRPDGSTGSRGKSPDAKSHKGPNRVRKPDAESGEGSMESLPQASLDGVGGGESPQKS

SEQ ID NO: 791943 - protein, 143 aa, Homo sapiens
PVLIQLCGGGSASCLQLGQKLWGPSRALGSHLCTSSQSPRPRCRPAKRRIPAETSRLTQSLSAHLLFPGRALALLIPVWFRRCGRRRHLDCTGKAPGVDLERQERSVEESAPGRGNSLCQGPETPAGEPNNGNSQHLPRQGMF

SEQ ID NO: 791944 - protein, 104 aa, Homo sapiens
MRIRGRWPSRPLTLRLQGPRKTTDRKPGSGGVLCSGPPSRSTHPYPRLPGRLFRKPRPFPAARGRARLLITGSARQYKTSLAPGAPPTGQPRPFPLTPPRPSAV

SEQ ID NO: 791945 - protein, 120 aa, Homo sapiens
VFCHLPSFSQALVTSAPWVHVLGRGSQLRGLGPWCREPHSTSKASHPSLAFQNSQRPQVSILRNEPFTPAHTVLEEHATLHFQKPINCTCPPCGEDKVSGEMKGLSHCPSRWLGQARQFC

SEQ ID NO: 791946 - protein, 129 aa, Homo sapiens
FGSLGLMTSVLVCPDGKTIEAEAAHWTVTRHYREHQKGGPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 791947 - protein, 159 aa, Homo sapiens
MTEPTKGSRVLSPHLPPSLTSCTSMKITFVPPTRNFLQLSKCSLSWCTLRPLHGANPSLKSLCPHAFIWRTHTSVQTLRCDCFRVTAFSAISLGLENTFCKLQGELLSSPFPGALLMPLSQHSAHDTRITGSQSPASKGSACMPPGVISRAPSSVPVQW

SEQ ID NO: 791948 - protein, 350 aa, Homo sapiens
MAPAHAKLALLGIVPRAMFPSITGYPWHQGMMVGIGQKDSYLGDEAQSKCSILTLKVPVDHRIITNWDDMEKIWHHTFYDELHVAPKEHPVLLPEAPLNPRANRKKMTRIETFNTPARYTAIQAVLSLYTSGYTTGISYTAETHTVPVYKGYAFPHAILCLDDWHLTNHPMEIFREPSYCFTTTAKREILCNIKEKLRKWPPQRPPPPWRRSEELSKWFQCLEVLFQASFLGMESCGIHQATFNSIKCDVHIRKDLFANMVLSGDTPVYLGITYMMQKITTLVPSSKKIITFPERKSLCGLAAPSWPPSSRCGSSSRSRMNQAPPSPTANASKWTASRHVSCASWINAEV

SEQ ID NO: 791949 - protein, 114 aa, Homo sapiens
TRAQSLALPTPLSGLRAAQQGQSGLGWDDTCARGCRRTVPACPTHPAPEGTLACGISQHTVPGRRLRESQAPGIPAQKLPQRNPVLQGSFRHNSNSLLDFPDTRKGARGTHQLS

SEQ ID NO: 791950 - protein, 529 aa, Homo sapiens
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQAVSERLFYYVAVSLMSHQTLEHMEGAMESMKPLLPILHWLKHPGDSIYKDVTSVHLDHLRVYWQELLDLHMEMGLSIEEALMYSFQRLDSDISLEIQAPLEDEVTRNLSLQVAFSGATACMAHVDGIHLHVANAGDCRAILGVQEDNGMWSCLPLTRDHNAWNQAELSRLKREHPESEDRTIIMEDRLLGVLIPCRAFGDVQLKWSKELQRSILERGFNTEALNIYQFTPPHYYTPPYLTAEPEVTYHRLRPQDKFLVLASDGLWDMLSNEDVVRLVVGHLAEADWHKTDLAQRPANLGLMQSLLLQRKASGLHEADQNAATRLIRHAIGNNEYGEMEAERLAAMLTLPEDLARMYRDDITVTVVYFNSESIGAYYKGG

SEQ ID NO: 791951 - protein, 529 aa, Homo sapiens; identical to SEQ ID NO: 791950

SEQ ID NO: 791952 - protein, 114 aa, Homo sapiens
MWAWCVVGGKGSLSDPFCLLLLVAGACMLWWLRPNPICLGISPVWKTGPGAMHTKLLGKAESTPRLLTKTCGGGRLPLSTQGSRNAAKNKSCSHQEMQVTPMDQKKDRNMTENW

SEQ ID NO: 791953 - protein, 315 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 791954 - protein, 315 aa, Homo sapiens; identical to SEQ ID NO: 791953

SEQ ID NO: 791955 - protein, 78 aa, Homo sapiens
VHVDWTRLSFRDILGVIAFVLLILGAGLYLWKKCGKKKKKKDEEEEEEEEQKEEEEREETGIGRLHFSIEAQISPLPH

SEQ ID NO: 791956 - protein, 571 aa, Homo sapiens
MALPRPSEAVPQDKVCYPPESSPQNLAAYYTPFPSYGHYRNSLATVEEDFQPFRQLEAAASAAPAMPPFPFRMAPPLLSPGLGLQREPLYDLPWYSKLPPWYPIPHVPREVPPFLSSSHEYAGASSEDLGHQIIGGDNESGPCCGPDTLIPPPPADASLLPEGLRTSQLLPCSPSKQSEDGPKPSNQEGKSPARFQFTEEDLHFVLYGVTPSLEHPASLHHAISGLLVPPDSSGSDSLPQTLDKDSLQLPEGLCLMQTVFGEVPHFGVFCSSFIAKGVRFGPFQGKVVNASEVKTYGDNSVMWEIFEDGHLSHFIDGKGGTGNWMSYVNCARFPKEQNLVAVQCQGHIFYESCKEIHQNQELLVWYGDCYEKFLDIPVSLQVTEPGKQPSGPSEESAEGYRCERCGKVFTYKYYRDKHLKYTPCVDKGDRKFPCSLCKRSFEKRDRLRIHILHVHEKHRPHKCSTCGKCFSQSSSLNKHMRVHSGDRPYQCVYCTKRFTASSILRTHIRQHSGEKPFKCKYCGKSFASHAAHDSHVRRSHKEDDGCSCSICGKIFSDQETFYSHMKFHEDY

SEQ ID NO: 791957 - protein, 184 aa, Homo sapiens
MGFCCVAQAGLKLLSSSDLPASVSQGAGITGVSHCAQPGHYHFYHQIPKLATPRDISLLVIKEASSRARNNIQILDPLDHIARLTNYTLTSCFSSNKVPTMPGSLPTGSKQGNVQTLDSIRWMPATPVPAPECHQKYAISTETAFPTLSTFMNTEKSVKGSNADFTKRNPRWRFLFGIYCRWGS

SEQ ID NO: 791958 - protein, 145 aa, Homo sapiens
MIPKLATPRDISLLVIKEASSRARNNIQILDPLDHIARLTNYTLTSCFSSNKVPTMPGSLPTGSKQGNVQTLDSIRWMPATPVPAPECHQKYAISTETAFPTLSTFMNTEKSVKGSNADFTKRNPRWRFLFGIYCSLHHAMTIFI

SEQ ID NO: 791959 - protein, 108 aa, Homo sapiens [sequence omitted]

SEQ ID NO: 791960 - protein, 76 aa, Homo sapiens
AVIYVCCVYTVEYLQTLCQCAMLPSPAFRDTNLGAEKQRWQDYLHHGNRQKLLIKPSLFCLYCLDLESDCNVNNAD

SEQ ID NO: 791961 - protein, 146 aa, Homo sapiens
DRVSLFLPRLECNGAILAHHNLPLLGSSDSPVSASPVAGIKGMCHHARLIFVFLVEMKFLHVGQAGLELLTSGDLPASASQSAGITGVSHRARPRSCIKKKKRSSRHSVVPVDPALASLGVVTVLHCGVMCHSHRATLGHSADHTN

SEQ ID NO: 791962 - protein, 102 aa, Homo sapiens
FLVTIGSVRRAGSRLLAHASCALFSLPPSSSPLLLSLFPFPPTSREPWLSVRVWERESTPDSHPLGRAAAVRVRVPVRRRALVRGPQLTRPRREGEGAAGAR

SEQ ID NO: 791963 - protein, 84 aa, Homo sapiens
APGENTPIRRSAFVDGLLGSKGLSERNDEQGGLEVQLGQGLGNVEFSSSEFLHISTYACMCVYVCVFSNYSPKSKMKIVCFQGF

SEQ ID NO: 791964 - protein, 136 aa, Homo sapiens
MAGVGGNTGPPRLVEGQVISLGFPLGPVQDSHPFGGTSGQNVEVGEEKPAPCAPAGSPRGEPGKENREAGSGDPGVGEGARRSPCGRGRAPSPRASVSPLYCGGPVGCRDRWGLAAGRGRPRLPRGALGAGRGRGG

SEQ ID NO: 791965 - protein, 128 aa, Homo sapiens [sequence omitted]

SEQ ID NO: 791966 - protein, 237 aa, Homo sapiens
AAEEAAAAGGSSGGGGTGSGPAGRASPGALRGGELGGLRVPQDRSGQSKMAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNRGIAGTKYPYQPITTDLHYYYILGAVE

SEQ ID NO: 791967 - protein, 185 aa, Homo sapiens
AAEEAAAAGGSSGGGGTGSGPAGRASPGALRGGELGGLRVPQDRSGQSKMAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESM

SEQ ID NO: 791968 - protein, 123 aa, Homo sapiens
KEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRI

SEQ ID NO: 791969 - protein, 501 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791970 - protein, 501 aa, Homo sapiens; identical to SEQ ID NO: 791969

SEQ ID NO: 791971 - protein, 501 aa, Homo sapiens; identical to SEQ ID NO: 791969

SEQ ID NO: 791972 - protein, 547 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAVWAGLRLRELGRARGARGAGPGAPGVGPGAEAASSGQPPSPALALQIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791973 - protein, 339 aa, Homo sapiens
MTGLGPALQRAPSGWWGGRWCQLAAFLPGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791974 - protein, 501 aa, Homo sapiens; identical to SEQ ID NO: 791969

SEQ ID NO: 791975 - protein, 472 aa, Homo sapiens
MLLLSTPQHVYHAKQIYRVTTYYVLELIDIHGTLPLMFLWSVPCAVPICSVFELLLLGPIGEVSLGTPIKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791976 - protein, 354 aa, Homo sapiens
MYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791977 - protein, 501 aa, Homo sapiens; identical to SEQ ID NO: 791969

SEQ ID NO: 791978 - protein, 501 aa, Homo sapiens; identical to SEQ ID NO: 791969

SEQ ID NO: 791979 - protein, 501 aa, Homo sapiens; identical to SEQ ID NO: 791969

SEQ ID NO: 791980 - protein, 294 aa, Homo sapiens
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSCSWWSSWVGGCCCCWASPSAS

SEQ ID NO: 791981 - protein, 386 aa, Homo sapiens
MGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791982 - protein, 410 aa, Homo sapiens
MGTTWLLKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 791983 - protein, 131 aa, Homo sapiens [sequence omitted]

SEQ ID NO: 791984 - protein, 268 aa, Homo sapiens
MVLGRPQRLLLNKRNEGACVTSPGLLNLRLHPGTPWGRGFVWSIGLSSIGQSGFAQLPPRVRSGPDGSRPSLCPWLHSLNTGDPRRHALSEGNSASAEPGASPLRSPRLLVLASQSSLVSKGLCLICTGFGRRTLSRNNATPGSECPMLPPLKCPDFWPYVTSWVARALGTRGCAPGYHQLRPLSNSPCTETTTRVTPAGPVRAQPGSGDQAGAWHTWRRPLTPPRTGPHPGTLSLGASGGGAGPWRRRQRCAPRRGARRVHRPRRRP

SEQ ID NO: 791985 - protein, 73 aa, Homo sapiens
QKQLRPRGAKAPKQGLQQAGSTVEMEPAPLSSTACLREEQPRGPGLVSGVSSAVDTRHGLSSPPTDKCNLSLL

SEQ ID NO: 791986 - protein, 328 aa, Homo sapiens [sequence omitted]

SEQ ID NO: 791987 - protein, 104 aa, Homo sapiens
KIKLKPLSTTKQTKTSKNLGFSHKFLDDIAHLFIVKLYRLFFSLQLVRAIPDSQRHHHQTVLRREFGLILHIVLSARYGVQSNFAKLTWLPLRMMNSLSYQCIM

SEQ ID NO: 791988 - protein, 127 aa, Homo sapiens
MPGIPKVQRCLKNLGYGCIAGFVHFTQHKSEVPWSTVTLRMPALAVPWLWVGGFLCGSSRFCLGSQFTGTWAPRTQGHLRGVMLDTSHGCLLCDGSWISEFSFRFQEIRKKDKREGGKAGNEGSTHF

SEQ ID NO: 791989 - protein, 177 aa, Homo sapiens
KLPLPWWKSAQAGPEDRSPGGLGLGQDETPAVPSPMPPQTGPRTQPPSRRQQEHRGRRAAVAIFKGDAAYLSGVERESAQPMRMREAPAVAPVTVVPTVVLETSPRGFAEQEPSVAVLGYRGSELRSHLSTGSKGNSPDASSRKGPTMKMKPQVETGEAARDPSLRPARTVFVGVSL

SEQ ID NO: 791990 - protein, 128 aa, Homo sapiens
MPTRHASFLAPRGAERHTPDSALVPRARVLHAQPRPSRSPRTLPSGPMRQLAPQGRKSAFLGSLAPPGRCAQPARQPRDGVRAASPASPSGPLPPAGRPPSAGFRERVLAPARPPGPRRTEGASPFPA

SEQ ID NO: 791991 - protein, 103 aa, Homo sapiens
MVDVGCKRRPSLNTLTTQIPGRSRLCWARDSARPAPGREDGASELRLTKENMEPEEMVSQRKPAPKEGKVRCCQAKKKDVMDKETTFFQLKIGVEARVIPLLV

SEQ ID NO: 791992 - protein, 106 aa, Homo sapiens
GVLLCDRLHSCDDYCIVHLLILMMYRLSKAQLLYNVQINTNSISGKRKGTTVTYGPNLMIHIKLIIIILPPLSPSSPLRNKNQSLSHCLVIYAVLTQKGKFTSHEF

SEQ ID NO: 791993 - protein, 110 aa, Homo sapiens
VEMYSLTVLEARSPKPSCQQALAPSETRDGILPCLFLASSGGRQALAFLGLQTHHCNRCLCHHMVFSLCVSVCVSSSLLIRTPIILDSGSTLLQYGLILTNYVCNGPISK

SEQ ID NO: 791994 - protein, 296 aa, Homo sapiens
RLPGNAARAMEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAIRNPLTITDTFFYSYFRSLRVIDKKVTLVDKDLLKFLKLEELVLSANRIKEVDATNLPPTLKVLELYGNEISSMECLCAHPPAGLQHLGLGHNKLLGPLESLYVTANHWPNLVSLDLGFNDLTDLQSMVTSLRTLRHLRLLVLQGNPLALVPYYRGLTIDSLAQLCVLDDITVSP

SEQ ID NO: 791995 - protein, 242 aa, Homo sapiens
RLPGNAARAMEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAIRNPLTITDTFFYSYFRSLRVIDKKVTLVDKDLLKFLKLEELVLSANRIKEVDATNLPPTLKVLELYGNEISSMECLCAHPPAGLQHLGLGHNKLLGPLESLYVTANHWLLAPCSPGFLTP

SEQ ID NO: 791996 - protein, 271 aa, Homo sapiens
RLPGNAARAMEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAIRNPLTITDTFFYSYFRSLRVIDKKILSWPVVLPAVDSPLSAKKGKGEKDKKGKEKDRTGKGEKEPAKEWKVLKKKKEPPKELRQDPPILQVLGRGLVILEPLLAGEPLVSTVCNFGVVRTLTSDRLTLARDSKKIKKVAKKARCGGGCL

SEQ ID NO: 791997 - protein, 305 aa, Homo sapiens
RLPGNAARAMEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAIRNPLTITDTFFYSYFRSLRVIDKKILSWPVVLPAVDSPLSAKKGKGEKDKKGKEKDRTGKGEKEPAKEWKVLKKKKEPPKELRQDPPILQVLGRGLVILEPLLAGEPLVSTVCNFGVVRTLTSDRLTLARDSKKIKKVAKKEKPKAVIPIYEGDYHPEPLTVEVQIQLNQCRSAEEALRMFAV

SEQ ID NO: 791998 - protein, 147 aa, Homo sapiens
RLPGNAARAMEASYESESESESEAGPGTQRPGTGTVSAAVREHLRKLCLREFPCGAGSWNKSRFLPQTWRTWRELVPREEDVVSPGEETVEALLGLVRSRHSPWALLNNSNAEDSFLRELAISRQPEEVNVGGHMLLDFKTHAYMNM

SEQ ID NO: 791999 - protein, 251 aa, Homo sapiens
MRSPLATAAVEQQDNKSRFLPQTWRTWRELVPREEDVVSPGEETVEALLGLVRSRHSPWALLNNSNAEDSFLRELAIRNPLTITDTFFYSYFRSLRVIDKKVTLVDKDLLKFLKLEELVLSANRIKEVDATNLPPTLKVLELYGNEISSMECLCAHPPAGLQHLGLGHNKLLGPLESLYVTANHWPNLVSLDLGFNDLTDLQSMVTSLRTLRHLRLLVLQGNPLALVPYYRGLTIDSLAQLCVLDDITVSP

SEQ ID NO: 792000 - protein, 171 aa, Homo sapiens
GWRKGGLLHQPFLGACLLAPSHPFHADPPQSPYPASRSSLGQGRREPQGRARERVGAAERTGRGKNPTAARGWAGRAEPVGGRGGSSRPRASRDPGTRADGTRPPRSCRGAPFPTEATEVPKAPATRRGLESAGARPPRPARVPRPKPGAPGPAPPGPRPRPNQSWFRAAA

SEQ ID NO: 792001 - protein, 81 aa, Homo sapiens
MGFYHSTAASAHGYFPLAFSFESTYVQIATCTTVPSWGALSELQLSPLASLGTPSVILCTVGRDASSRCCLERLLLLVPNP

SEQ ID NO: 792002 - protein, 164 aa, Homo sapiens
GWNPAQESARRKTKTGRQASPFKRLPSGNKRAGCPAAYSRHWARLELGHSSSRYDMPCAAHFLSRGIKQAMALLVPSKASTLLAASLARPACRCAQLPGRWQSYVSRAERELGAVRQFCGSGEIRGPGPGKEGEGGKGASLHSFVVNSLHWFSVWLDHRLARGR

SEQ ID NO: 792003 - protein, 83 aa, Homo sapiens
HPRDCPRELAPGECSCRSQLTSWVCSLSRPSQLHRGPPRTWQRGGAGTHPTGADAIASKAAVHHVQRHDSEGRQPLGEPLPVM

SEQ ID NO: 792004 - protein, 107 aa, Homo sapiens
WLHASPGPLGVPLRESQACRAAASPGCPQGPQCGLGETPLLVLAFSYSLEWTFFFGLSSQQGLFFVVAEREQGAFVEGAGVGQPGRAWVGARILQGMGMGLGPRPWS

SEQ ID NO: 792005 - protein, 95 aa, Homo sapiens
RAARWPVTAPHSFAFWARGLNRAFQHRHFCRPALPATERFHVLGGLASVCCRPADMSRRVQTRGGYWGHQGVEPAGSVASRPGLGQWVQPSLGLS

SEQ ID NO: 792006 - protein, 126 aa, Homo sapiens
MPELAKSAPAPKKGSKKAVTKAQKKDGKKRKRSRKESYSVYVYKVLKQVHPDTGISSKAMGIMNSFVNDIFERIASEASRLAHYNKRSTITSREIQTAVRLLLPGELAKHAVSEGTKAVTKYTSSK

SEQ ID NO: 792007 - protein, 102 aa, Homo sapiens
LLMSSLPFPVPPDTPHPLTHTHTLLFSDFLPLQDKKPVLFLEDHTNSCLALRHSCQGAKQLSRNYGQGHSTNTPAHFSDNQTNIPYITESSGFLTTEISCPK

SEQ ID NO: 792008 - protein, 114 aa, Homo sapiens
PPAAWHRSYPPNWKCRLGEGHQAQGKVGRKPWDQQSLWKRRSSLHPALGQADCVDQILGLPPLAFGEGSRRGSSAQLQVKGWHCFPTAAAPARQPCPYCSLLQAPMPAPLTYPG

SEQ ID NO: 792009 - protein, 217 aa, Homo sapiens
MNIDARTLNKILANQIQQHIKKIIHHDQVGFIPGIQAWFNICKSINVIHHINRIKNKNHMFISIDAEKAVDKIQHHFMIKTFSKIGIQGTYFNVIKVIYDKPTANIISIPSGTRQGCPLSQILFNIALEVLARAIRQEKEIKRIQISKEEVKRSLFADNTIVYFENPKDSSRKLLEPIKEFSKVSGYKTSVHKSVSLFTTTATKQRIKSRTQPLGQV

SEQ ID NO: 792010 - protein, 104 aa, Homo sapiens
MKSLRTQMLIGPGTGLPMSRAPLLPCLVLSEYPQSKRDLETPGWRVLGDSPRVRDRVESRAGTSLSSLRAWRTAGAKVEAGLSSVLLPWSWFGLSKPGNLLHGS

SEQ ID NO: 792011 - protein, 112 aa, Homo sapiens
RGTKKAWGLRERSFQFPRDRNPPQPRFLPQRGLLIGVIGVWFAARPHKATQSSLGSLVTENDVTLAGFGGCSFWRGRSGPRGVVATEPRRGGARLWVRGRGGPFIPGQVGQQ

SEQ ID NO: 792012 - protein, 75 aa, Homo sapiens
GAFVTRAEDRRDLPTRASRCCWWRELTSNACGPGEQNLPLHPTPRLSPAKGASFGRPHEVRKSLFSSSWISLQEY

SEQ ID NO: 792013 - protein, 95 aa, Homo sapiens
SQLRLWKQVTTDGGSSSTNVSLTVLEAGCPRSRCQQARQQARFLPGFPGPAGAAFLLRARRSVCVLVSLFPLLRRTLVIADPGPTCVASFYLTHL

SEQ ID NO: 792014 - protein, 259 aa, Homo sapiens
TDYCGIHLISGSRDTTCMIWQITQQGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEVKPSISNFISHAVGDYFGSPSFQLIEKSPLGINKLKAKFDFSKGSK

SEQ ID NO: 792015 - protein, 99 aa, Homo sapiens
YLRISLLKGTYKDPVYKRSHSLNLSINPLAMRLPIHCVCVTKEYSHILVGLEDGKLIVVGVGKPAEMRSGQLSRKFWGSSKRLSQISAGETEYNTQDSK

SEQ ID NO: 792016 - protein, 254 aa, Homo sapiens
TDYCGIHLISGSRDTTCMIWQITQQGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSKSRITKQQR

SEQ ID NO: 792017 - protein, 255 aa, Homo sapiens
TDYCGIHLISGSRDTTCMIWQITQQGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEVKPSISNFISHAVGDYFGSPSFQLIEKSPLGINKLKAKFDFS

SEQ ID NO: 792018 - protein, 108 aa, Homo sapiens
SCESCRSLALGRGLMILSPLRKFRSLDSNSGTCFSWTGWLWVGELCLLAIVLWTFNSPSLESTVPSATVFLMGQGQHVLAGEMKNQKTGFGSFHWCLCALWSPFRGVW

SEQ ID NO: 792019 - protein, 67 aa, Homo sapiens
KRVHKLGRSHFHRMHRSQRKDTENMKKQGNGAPPTEPSNSPAADPHPKETEDILERELNIHIIQLWA

SEQ ID NO: 792020 - protein, 94 aa, Homo sapiens
ALLQLFNSTFYGKSSLQQHARVWRCSNKTLFTRTGNGLGLAAELFADPAPRQRKEVQEGCNESRGLDWELVRQVQRALGQNSRHLAQVSQPTPL

SEQ ID NO: 792021 - protein, 37 aa, Homo sapiens
ETCLLKVYSPCGRWSNPDTSQIISALCSELWVFYPTQ

SEQ ID NO: 792022 - protein, 103 aa, Homo sapiens
ETGFCFVTEAGVQWCNDIIIGHCNLDLLGPSKPPTSASQVAETTGMHYHTQLIFFTFVDTGSPYVAHAGFKHLGSSNPPPSASQNAGIIGMSHRAWPSFTFKK

SEQ ID NO: 792023 - protein, 192 aa, Homo sapiens
MVPPKHRRALIWFGCVPTQISFFFNSELFIGLLLPKGYPASAGLMPQNFGVIGLRHHFAIHYPAGGGLLDGLHGVAAVQGITKIKVLAIFQQAAVGGDLSLQLDLDVQQGLILLGLALSLCPGLCQLCLKVQQDPVELLHLEGERASTSLRLFSKLAFRFLMESRSISKDWTVRLSSVSVVSAAPTSLVPNP

SEQ ID NO: 792024 - protein, 171 aa, Homo sapiens
IGPHTFNHLIFDKPDKNKERVKDSLFNKWCWDNWLAMYGRLKLNPFLPPYTKINSRWIKDLNVKPKTIKALEDNLGNTILDIGTGRDFMMKMPKAIATKAKIDKWDLIKELLHSKRNTNRVNRQPIGWEKISANCASNKGVISSIYKEHKQIYKKNYELILYMCLHVCEIV

SEQ ID NO: 792025 - protein, 171 aa, Homo sapiens; identical to SEQ ID NO: 792024

SEQ ID NO: 792026 - protein, 70 aa, Homo sapiens
FRSQMNPDEPQSQMNLRAKVNLTLKSLKTGLVAESIISRQLAFQGFLRRASNPLHTAFISSWGRSYVFAS

SEQ ID NO: 792027 - protein, 76 aa, Homo sapiens
VVVVEMGVGVGVCVPVGVGVGVTVMVVVMGVDVGVCVPVGARLSMGWGRSAEQGTGGGSEQGPFGSQNMTSWGFSL

SEQ ID NO: 792028 - protein, 311 aa, Homo sapiens
GAQILVVEWWGLVILLFCDWTTAQVLDDDQECALGMLEVPLCQILPYADLTLEQRFQLDHSGLDSLISMRLVLRFLQVEERELGSPYTGPEALKKGPLLIKKVATNQGPKAQPQEEGPTDLPCPPDPASDTKDVSRSTTTTTSATTVATEPTSQETGPEPKGKDSAKRFCEPIGEKKSPATIFLTVPGPHSPGPIKSPRPMKCPASPFAWPPKRLAPSMSSLNSLASSCFDLADISLNIEYAPLCLIFSKIACMKNTSLDGKVDMNLHFCASCFFTKYLPKRQHGVVERTQDKGERAKQAVYGSSCVLTIK

SEQ ID NO: 792029 - protein, 206 aa, Homo sapiens
RSVLHLEHNQLCGSSCVLTIHRSSDTKDVSRSTTTTTSATTVATEPTSQETGPEPKGKDSAKRFCEPIGEKKSPATIFLTVPGPHSPGPIKSPRPMKCPASPFAWPPKRLAPSMSSLNSLASSCFDLADISLNIEYAPLCLIFSKIACMKNTSLDGKVDMNLHFCASCFFTKYLPKRQHGVVERTQDKGERAKQAVYGSSCVLTIK

SEQ ID NO: 792030 - protein, 99 aa, Homo sapiens
GAQILVVEWWGLVILLFCDWTTAQVLDDDQECALGMLEVPLCQILPYADLTLEQRFQLDHSGLDSLISMRLVLRVNLSGPLGEGRNRALAMEQGVLPQH

SEQ ID NO: 792031 - protein, 170 aa, Homo sapiens
MSEELAQGPKESPPAPRAGPREVWKKGGRLLSVLLAVNVLLLACTLISGGAFNKVAVYDTDVFALLTAMMLLATLWILFYLLRTVRCPCAVPYRDAHAGPIWLRGGLVLFGICTLIMDVFKTGYYSSFFECQSAIKILHPLIQAVFVIIQTYFLWVSAKDCVHVHLDLTW

SEQ ID NO: 792032 - protein, 632 aa, Homo sapiens
ERGALRGAAAGPSRRGRTHQPLRYHLATPAEATPTAWLKPRGHQAEALEMPLHQLGDKPLTFPSPNSAMENGLDHTPPSRRASPGTPLSPGSLRSAAHSPLDTSKQPLCQLWAEKHGARGTHEVRYISAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYMLGVLFFAIACFLYKPLSESQFSLSASEAATLFGYLVVPAGGGGTFLGGFFVNKLKLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIASSRAASDHRPRPPGHGGHSAFPDDRTVPLGDAITRELLFDLQPST

SEQ ID NO: 792033 - protein, 149 aa, Homo sapiens
SGAFTLATSAAPTMAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISQEDLLMRLLECDVIIYNITESSQQMEEAIWAVSGQ

SEQ ID NO: 792034 - protein, 120 aa, Homo sapiens
SGAFTLATSAAPTMAEEEETAALTEKVIRTQRVFINLLDSYSSGNIGKFLSNCVVGASLEEITEEEEEEDENKSAMLEASSTKVKEGTFQIVGTLSKPDSPRPDFAVETYSVSPGGSGQE

SEQ ID NO: 792035 - protein, 272 aa, Homo sapiens
SGAFTLATSAAPTMAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISQEDLLMRLLECDVIIYNITESSQQMEEAIWAVSALSEEVSHFEKRKLFILLSTVMTWARSKALDPEDSEVPFTEEDYRRRKSHPNFLDHINAEKMVLKFGKKARKFAAYVVAAGLQYGAEGGMLHTFFKMAWLGEIPALPVFGDGTNVIPTIHVLDLA

SEQ ID NO: 792036 - protein, 222 aa, Homo sapiens
SGAFTLATSAAPTMAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISQEDLLMRLLECDVIIYNITESSQQMEEAIWAVSALSEEVSHFEKRKLFILLSTVMTWARSKALDPEDSEVPFTEEDYRRRKSHPNFLDHINAEKMVLKFGKKAVIYAH

SEQ ID NO: 792037 - protein, 157 aa, Homo sapiens
GEFQEVDKIMTSDEVSETSTLVTPEPLTFVDPVLTEATPKEKECEELKSCPWLSLPGNSAISNVDNGKEELCKPNLVCEADDNHQQLHGHHNEQPSSTHDSPTATSPLKENSEVSCFTSDLSGPESRTISLENCGFEGGGLLKRSAEKTDSSYFYRG

SEQ ID NO: 792038 - protein, 89 aa, Homo sapiens
GLWLVEKHWLPLLSLNEACRASSRTCTLPLIMFMIGRKWIKSGQKVKKKRWPPERDIHIYLSTYQDTCFGSLLLLREIPGYPGETSDNK

SEQ ID NO: 792039 - protein, 92 aa, Homo sapiens
SAKRAARLKRGPSPEFDWTKGAARIVKENYCFGDRVHALSLQATVQVVQSSLIQTCVSQVQVILLSQPPQQMRLQVCTTTPSTLGGQGGRIT

SEQ ID NO: 792040 - protein, 155 aa, Homo sapiens
MGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLVSK

SEQ ID NO: 792041 - protein, 184 aa, Homo sapiens
MGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTPPWQTQSPRKANGRMKRSLQQKRHRRSYMPS

SEQ ID NO: 792042 - protein, 119 aa, Homo sapiens
WGLGATTLKKGGRSPDEVTLTSIVPTRDGTAPPPQSPGSPGTGQDEEWSDEESPRKAATGVRVRALYDYAGQEADELSFRAGEELLKMSEEDEQGWCQGQLQSGRIGLYPANYVECVGA

SEQ ID NO: 792043 - protein, 115 aa, Homo sapiens
MPVIAPEDFPVGQDVVVEDSDIDDPDPVLAYDNGSQYVGQAGLEILASSNPLASASKSGGITGMGHHALPLPFLHLDMFGHKNAPGLQWPTVFSTVTCCAGLWHRSNRLYYSYRL

SEQ ID NO: 792044 - protein, 98 aa, Homo sapiens
MKWLCQDSIREAPPPHGQRAGALLEGIGPSAKMELQAVCETLLPGSGAGPEASRTGGQERRWARSGKGQGPPGLHEATREPTWTVQCPTSVSYHFMLH

SEQ ID NO: 792045 - protein, 133 aa, Homo sapiens
MGACTPRLVPDSGGPALAVVGPSPHLKIMGVGLDPGSNQKSQRFSRDAAEARGAEETPASDRLGAISSSAHCSCGPCSTSLHPSVPQPPHQQSHSMAQKSERETVAMCGGWHTMGLWKNVSSPQGSLWPHPLL

SEQ ID NO: 792046 - protein, 147 aa, Homo sapiens
GLSTEVGVLHLPELLLDMLLGPDLRLQADCSSSRADMSSFWLRRTFHSGSSVLDPRLELLKASSSSVILEARAMTVTHANFQSSVDFLGFHLQSSGLLQKEFFLCKFIYNINEMFLNFLANCPRKVDFQYRELLLPPISKMLEPPLL

SEQ ID NO: 792047 - protein, 129 aa, Homo sapiens
MLPENRTNLSSVHGILSFIQSSTRRAYQHIVDEMGENRRPVQYGRSAATTSNPHRDNIRYGTSNIDTSEGTSDDMTVADAASLRRQIIKLNRRLQHLEEENKERAKREMVMYSITIGLWLLSNWLWFRR

SEQ ID NO: 792048 - protein, 70 aa, Homo sapiens
NDYWVVILAPSFNLATLEVLIGPIQLTRNSLHVTNYSLTIGISPRAKIRQRNQVIKKLRKLQLRIDKKIE

SEQ ID NO: 792049 - protein, 727 aa, Homo sapiens
GTMEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 792050 - protein, 727 aa, Homo sapiens; identical to SEQ ID NO: 792049

SEQ ID NO: 792051 - protein, 727 aa, Homo sapiens; identical to SEQ ID NO: 792049

SEQ ID NO: 792052 - protein, 707 aa, Homo sapiens
GTMEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 792053 - protein, 492 aa, Homo sapiens
GTMEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGKKA

SEQ ID NO: 792054 - protein, 349 aa, Homo sapiens
GTMEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDQNQEPLREEDSDFILTEGDLTLTYGDSTVTANGSSSSHTASTSLEGSRRTKSSSEEVLERDLGMGDQKVSSRGTRLVFPLEDNA

SEQ ID NO: 792055 - protein, 130 aa, Homo sapiens
YNHPFLCPSSIHPPIPLSILPFFPPSTYSPIQPSIPPSIQTSIHPLNKSMALPHWPSFISSVNPFSPTSEPSRTSPPIPIYTPREYLLSLRKASPKSQSEVGPPAIPLLKNLIPSFSTVVIDITKRLLLG

SEQ ID NO: 792056 - protein, 125 aa, Homo sapiens
GLHYNLALHVDQEIGGRSSGLQFIMTAIGKFNCPSWLVCLKSMCNRDQALALGGESSWHPLSILSWVLSHSDSAWWRDSHPFLPCLKTHISLRTDFQLPGLISQDILATLCVGTFNPGQRVMGYK

SEQ ID NO: 792057 - protein, 147 aa, Homo sapiens [sequence omitted]

SEQ ID NO: 792058 - protein, 120 aa, Homo sapiens
MLKSLVNEVTDGSWSMVGCLAGARAAMERLTCCQKCYMSRKKMGEKPGFLPTLPYAKVDSPISLAGSQLTREPVRVSPPTRLSRVGEKQAMDLRASSPPGLVYINMYCIRSAARGPRVLQ

SEQ ID NO: 792059 - protein, 116 aa, Homo sapiens
LACNGVISAHRNLRLLGSTDSHASASRVAGITGAGHYTQLIFVFSVVMGFHHVGQAGLELLTLGDPPASASQSAGITGVRHHAWPVNCLLSSLSPVGNLGYQLQLRAPQTCACPKH

SEQ ID NO: 792060 - protein, 150 aa, Homo sapiens
MGGNSTTTISELGFLALDGMWLVLQGSSYNGPRVSLCEGENILSTKKVEPPSFLEHSRRCIQTQIFVIADYCYYCQNSQLFLQGFGSPGLSTDAALGPVPPVPPLLTASVHSEDSPVMDLWGWIPLGWSALDRSPEMCHSRSCPGDSRCN

SEQ ID NO: 792061 - protein, 99 aa, Homo sapiens
LACFSKVMISTLGLGGSYIFLPAGTGSGPALPRGGCEPCGGRERTKWKGIFLPESHLLCMPVPAKDRRGETAAPRASSLLLRKKGTNKFSSILRILCSC

SEQ ID NO: 792062 - protein, 76 aa, Homo sapiens
TSLLVPAPAFLIIFQKHWMLLLGSGTDPFLALCTAQTPAVTFPSSEASPSVLGVPLAPSYSTFLEVKPVAPGPASL

SEQ ID NO: 792063 - protein, 221 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIDIPCNNKGAHSVGLMWWMLAREILHMCGTISHEHPWRSCLISTSTEILKRLKKKSRLLLKRL

SEQ ID NO: 792064 - protein, 198 aa, Homo sapiens
PRSGLSKSIYPADGRVLKETIYPHLLCSTSVQENKEQSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEDSPPHKVLKGHHQSVTSLLYPHGLSLWDIFTEEILHKF

SEQ ID NO: 792065 - protein, 83 aa, Homo sapiens
WPVGPMAIAKSDKRPYLWPPGPAGLENSAGAPRLGRVGAWNGPGWGRGAGVPALVCLGEFSPQTHLIAKKLILPCGRWYSPSK

SEQ ID NO: 792066 - protein, 117 aa, Homo sapiens
NFTGYFSVSSVDPSFLPNFLILHHFRVQSLAFICIHTYSLVITSVPMALKSICLPMTNTFILLLKLFSKLKTYVSNSLFDISWIPPNSHLKLIMSQIKLLIHPLHPAYFTCSLSQLS

SEQ ID NO: 792067 - protein, 74 aa, Homo sapiens
GEDKALKNNCSSLQHFTFHTRDKRPNPHYPLRSRKGNGTGLCLLGVGSHECCCRSATETPNTLGPMAAHLSLIK

SEQ ID NO: 792068 - protein, 574 aa, Homo sapiens
MLREFSKWGVEASPGKAWERKRSLLRGAVGRYRGATGGDLFWAPFPSWGTMEFPEHSQQLLQSLREQRSQGFLCDCTVMVGSTQFLAHRAVLASCSPFFQLFYKERELDKRDLVCIHNEIVTAPAFGLLLDFMYAGQLTLRGDTPVEDVLAAASYLHMNDIVKVCKRRLQARALAEADSTKKEEETNSQLPSLEFLSSTSRGTQPSLASAETSGHWGKGEWKGSAAPSPTVRPPDEPPMSSGADTTQPGMEVDAPHLRAPHPPVADVSLASPSSSTETIPTNYFSSGISAVSLEPLPSLDVGPESLRVVEPKDPGGPLQGFYPPASAPTSAPAPVSAPVPSQAPAPAEAELVQVKVEAIVISDEETDVSDEQPQGPERAFPSGGAVYGAQPSQPEAFEDPGAAGLEEVGPSDHFLPTDPHLPYHLLPGAGQYHRGLVTSPLPAPASLHEPLYLSSEYEAAPGSFGVFTEDVPTCKTCGKTFSCSYTLRRHATVHTRERPYECRYCLRSYTQSGDLYRHIRKAHNEDLAKRSKPDPEVGPLLGVQPLPGSPTADRQSSSGGGPPKDFVLAPKTNI

SEQ ID NO: 792069 - protein, 613 aa, Homo sapiens
VTLQPQTQVKENKTQPPVAYQYWPPAELQYLPPPESQYGYPGMPPALQGRAPYPQPPTVRLNPTASRSGQGGTLHAVIDEARKQGDLEAWRFLVILQLVQAGEETQVGAPARAETRCEPFTMKMLKDIKEGVKQYGSNSPYIRTLLDSIAHGNRLTPYDWESLAKSSLSSSQYLQFKTWWIDGVQEQVRKNQATKPTVNIDADQLLGTGPNWSTINQQSVMQNEAIEQVRAICLRAWGKIQDPGTAFPINSIRQGSKEPYPDFVARLQDAAQKSITDDNARKVIVELMAYENANPECQSAIKPLKGKVPAGVDVITEYVKACDGIGGAMHKAMLMAQAMRGLTLGGQVRTFGKKCYNCGQIGHLKRSCPVLNKQNIINQAITAKNKKPSGLCPKCGKGKHWANQCHSKFDKDGQTIVGKQEEGPASGPPTNWGIPSSTVCSSGFSRTTTPTENTTTSGSQPITTIQQLSRATAGSATVDLCSTQMVSLLPGEPPQKIPRGVYGPLPEGRVGLILGRSSLNLKGVQIHTGVIYSDYKGGIQLVISSTVPWSANPGDRIAQLLLLPYVKIGENKTERTGGFGSTNPAGKATYWANQVSEDRPVCTVTIQGKSLKD

SEQ ID NO: 792070 - protein, 73 aa, Homo sapiens
QESCQVGRRAKRFFKFLRWSHHPRGIAVWRWCLSRSRRNQREQQEELRDSFAESRNDRVSEKDVSILVPQGTN

SEQ ID NO: 792071 - protein, 78 aa, Homo sapiens
VSTGVPRKQAQTAKTKTVLAVSTGVPRKQAQTAKTKTVLAVFTGVPRKQAQTAKTKTVLAVFTGVPRKQAQTAKTKTV

SEQ ID NO: 792072 - protein, 101 aa, Homo sapiens
GRASWSPDGSQHRRGTEPSLQGQPPWASRLSLPCPGGEEAHPEGLGGVSGGELRVPRWMMEEPHMGYRDRQKDGEEETGRQTQGPLTGSEGGGAGGLDSWV

SEQ ID NO: 792073 - protein, 289 aa, Homo sapiens
RGQARPGPIRGLTACPAVHPEEARPLCPIRKSQGSGEVRMVAPAARVFLRAVRAALTSTVPDLLCLLARGSPRGLASGRLPLAVHSAQHGPGSGAPWLRIARRALRFVLSKHWGDDCYLTNRLWQDLKPPSHVENGQELRLAPPVQWALQVQGNQLQTAVLCLRMAPPEPAGSLPKNLERVYVDTQVSASGDFLRGRARGTAGPGGSGSGSPRGRGRLRRPGRSPGAAPSSVSRGRKEATQARSRARGRRGGAVARVCRPESRQRWARPTSSPGGLIRGRRKNGIEAFQ

SEQ ID NO: 792074 - protein, 593 aa, Homo sapiens
MKADLKQHHHHWSIFSYIRLRLPSMLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 792075 - protein, 202 aa, Homo sapiens
MKADLKQHHHHWSIFSYIRLRLPSMLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRIT

SEQ ID NO: 792076 - protein, 43 aa, Homo sapiens
NHSTRIKELLGHGLDRGEAADMFAQQKVFNLKAKAHGRWSVKG

SEQ ID NO: 792077 - protein, 117 aa, Homo sapiens
MAGGVEPFAVSVNCHGLLSHAESSTLVVSGWVKLHQVIKMPSCSVKEEKKIIDAGIVPKSPLLDFIWMSLHLNEKLSTFAKSTVGRSIKSSVLINYTYSLAKIGCVSHRQCSCRPCW

SEQ ID NO: 792078 - protein, 101 aa, Homo sapiens
GGAAQPEMALARPNWAGVPPFPHSRGGEGSLSLTTLYGRPPYLPGLGMASQEHSGSFLAEEALLASLAPVCVCVCVCVCVCVCVCVCVCARARVRAEVEGG

SEQ ID NO: 792079 - protein, 96 aa, Homo sapiens
MRPEDRMFHIRAVILRALSLAFLLSLRGAAIKADHVSTYAAFVQTHRPTRELMLEFDEDEMVYVDLDKKETVWHLEELAKPFPLRLKGGLPNTAIL

SEQ ID NO: 792080 - protein, 332 aa, Homo sapiens
KPNLVPRLAECLRAVLMALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 792081 - protein, 113 aa, Homo sapiens
AGARSARPASLTASLPPSLTQGLAEAEQLRGAADRALPTPGAARGPARTRKRRVPRLEHVPRLQPAARGSPARPARFVVYSKTVGHCVCTEVMWIPPRLISDQGCWACLGFLD

SEQ ID NO: 792082 - protein, 133 aa, Homo sapiens
KPNLVPRLAECLRAVLMALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSLCTARQWVIVYVQK

SEQ ID NO: 792083 - protein, 367 aa, Homo sapiens
KPNLVPRLAECLRAVLMALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSLCTARQWVIVYVQKLMWIPPRLISDQGCWACLGFQTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 792084 - protein, 106 aa, Homo sapiens
ENLYFHLQPLSKSRTKSPGSVFQNTASPVGKTPGASCLPRREWRPGGFAQTLTVLLPSDQLWGLAPLPLGRGLGRWASLHPSPCSPARDPEFQPRVMRGSNRYTYF

SEQ ID NO: 792085 - protein, 145 aa, Homo sapiens
MDEERGKKAATRRGKTSNTRPKPRRRNRDDTHTTEAHKQRTTNGPPTKPDALKDTTEAHTTDDGPKEDPPPRRPRPAEDPPRPGNRQSPELNPTPPQSAPRNKHGPRAHNRPAPPHNRTSPPPEGAPRTHPPHTQQHPGPPPDPR

SEQ ID NO: 792086 - protein, 151 aa, Homo sapiens
LGAIGLLETSRLLTATPKTPALTPRMEQLGLKGSIASVSLAQAEREMLLLPPFLHSLQQTQPGPNADDEEIQLLKKRERRKLLQLFDLLNIQEPIWHGFYGFILFCFALFFLEFMSCSDVMETVSVIVPTSCLLGEVRNNYVQSMNFHLGY

SEQ ID NO: 792087 - protein, 298 aa, Homo sapiens
RVPMQPWQCLRRFALAWWERTAEGRARSPREEAGPRDPGGRGEPDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQVGGWTVDPVCLLSSLCSHLHGDSAPSGAGQPAQTRSSRHTQGAQPGLADQAAKLSYASAESLETMSEAELPLGFSRMNRFRQSLPLSRSASQTKLRSPGTARPVHPPSPHRLLPLLFTPWSPLLPYSTPARLKLCSLSHSPFSPSNPSSLHLS

SEQ ID NO: 792088 - protein, 142 aa, Homo sapiens
SRRDPLGGWAAPGRARRDPAVPLSPLADPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQVSGLPAAAAAAAAA

SEQ ID NO: 792089 - protein, 144 aa, Homo sapiens
MGSDKQRGGGVLILGSSHPARPLQTRSSRHTQGAQPGLADQAAKLSYASAESLETMSEAELPLGFSRMNRFRQSHASLPLGQPDQAALPRYCPPSPPSLPTQAPPSALHSLEPPPPLQHASSPQALLSFPQPLLPKQPQLSPSL

SEQ ID NO: 792090 - protein, 224 aa, Homo sapiens
RVPMQPWQCLRRFALAWWERTAEGRARSPREEAGPRDPGGRGEPDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQTRSSRHTQGAQAASPPGVLFLQFGEETRRVHITHEVSSLDTLHALIAHMFPQKLTMGMLKSPNTAILIKDEARNVFYEL

SEQ ID NO: 792091 - protein, 145 aa, Homo sapiens
MSIFSAKNCDEKPVGLSFVIAHSLSCISIRHCCESRGDCQLQNFFHDLVFAWCLRENGCSSLPLTVHVWDYCLAAPVELILISSPNFRSSLLSITPHLCMWLSELTGDSVIARKGISCLCDYKYQGTDSPSPTPTSTLTQRCMTK

SEQ ID NO: 792092 - protein, 139 aa, Homo sapiens
PPTPGAALTFRAGGRGRGGGEGGGGERLLFLLFRALSRPCSAPTGPEHGWRPQPGREGGRAGAESETAPPPRTNKHRRLQPEPAPRPPPPAASFQPGSALQPPPAPPRRDESASLRCSVLPPARRAVAAVAAALGKWRP

SEQ ID NO: 792093 - protein, 87 aa, Homo sapiens
GCRLERARSRARSWGRLTGWCPQGRCRHPPASRRPGLSLPGPFLASSSCPRYRGARRRRPRPHPAMTERGPHPPPEHPKTPGNAVLT

SEQ ID NO: 792094 - protein, 128 aa, Homo sapiens
MAIFTILILPIHEHGMFFHLFVSSLISLSSGLWFSSKRSFASLVSFIPRYFILFVAIMNVSLFMIWLYACMLLVYRNASDFCTLILYPQALLKLLISLRSFCTETMEFSRYRIMSSANKDNMTSSLSI

SEQ ID NO: 792095 - protein, 174 aa, Homo sapiens
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVRRALIDKMSTTLYVWTF

SEQ ID NO: 792096 - protein, 400 aa, Homo sapiens
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVNRELKKLLVASVGDDLQYHFERLAREKNQLILENEALGRNTAQLSEQLERMSIQCDVWRSKFLASRVMADELTNSRAALQRQNRDAHGAIQDLLSEREQFRQEMIATQKLLEELLVSLQWGREQTYSPSVQPHSTAELALTNHKLAKAVNSHLLGNVGINNQKKIPSTVEFCSTPAEKMAETVLRILDPVTCKESSPDNPFFESSPTTLLATKKNIGRFHPYTRYENITFNCCNHCRGELIAL

SEQ ID NO: 792097 - protein, 400 aa, Homo sapiens; identical to SEQ ID NO: 792096

SEQ ID NO: 792098 - protein, 400 aa, Homo sapiens; identical to SEQ ID NO: 792096

SEQ ID NO: 792099 - protein, 400 aa, Homo sapiens; identical to SEQ ID NO: 792096

SEQ ID NO: 792100 - protein, 139 aa, Homo sapiens [sequence omitted]

SEQ ID NO: 792101 - protein, 104 aa, Homo sapiens
DLCGGIGTRGRGDLELSWKGVPENGFMAWSQREKDAAWTPSESLSLPSCLEMIVTRDFDDGPIQFLNFRRDHRILIVLLPSRPLSPAWVGFPLLGSLALQLIFL

SEQ ID NO: 792102 - protein, 118 aa, Homo sapiens
APRVPVGPQVGGSGRGRARERRPRLEVSGNEARPRLLPPLKDSFPRWRRDAALGPNPGFGRPSRFPGPFPRPGRGDGNGARATKAGSVTPPTCLVCRRGLPQCQALWSQNLAKKKTAN

SEQ ID NO: 792103 - protein, 110 aa, Homo sapiens
QIKKRNRLQAGLNSVVRVGLTENMRSESSLQGCEEVSFWQKSCEGLSGQRRLQCKSPEVGTCLVCLKESNEASVARTECARREGTEDVEGRSVCNCTPSMLILCVISRLY

SEQ ID NO: 792104 - protein, 108 aa, Homo sapiens
ETEFHTVYQIGVQWCNPSLLQPVGPGLKRSSHLCHLNRWDYRWVPPYPAVEKKMVGYYSVAQAGVELLASSDPPASASQSAGITGLSYFPRLFPRLLIHTMTLAFPTS

SEQ ID NO: 792105 - protein, 392 aa, Homo sapiens
MSCLYSRLSAPCGVRAFSCISACGPRPGRCCITAAPYRGVSCYRGLTGGFGSHSVCGGFRAGSCGRSFGYRSGGVCGPSPPCIATVSVNESLLTPLNLEIDPNAQCVKQEEKEQIKSLNSRFAAFMDKVHFLEQQNKLLETKLQFFQNRECCKSNLEPLFEGYNSATGGRVHGSHSGRLASELNHVQEVLEGYKKKYEEEVALRATAENEFVALKKDVDCAYLRKSDLEANVEALTQEIDFLRRLYEEEIRVLQSHISDTSVVVKMDNSRDLNMHCVITEIKAQYDDIATRSRAEAESWYRSKCEEMKATVIRHGETLRRTKEEINELNRMIQRLTAEVENAKCQNSKLEAAVAQSEQQGEAALSDARCKLAELEGALQKAKQDMACLIREY

SEQ ID NO: 792106 - protein, 109 aa, Homo sapiens
MWSTPCLCTSYCQFCLDSGCSPRRAGDIGSSNQHFSHFHTRCTSWSSRTSCWRQSCSSSRTVSAARATWSLCLRATTLRREAECMEANSGRLASELNHVQEVLEGYKKK

SEQ ID NO: 792107 - protein, 210 aa, Homo sapiens
MSCLYSRLSAPCGVRAFSCISACGPRPGRCCITAAPYRGVSCYRGLTGGFGSHSVCGGFRAGSCGRSFGYRSGGVCGPSPPCIATVSVNESLLTPLNLEIDPNAQCVKQEEKEQIKSLNSRFAAFMDKVHFLEQQNKLLETKLQFFQNRECCKSNLEPLFEGYNSATGGRVHGSQQWEAGLRAQPRAGGAGGLQEEVSAVGGGFGEIKWD

SEQ ID NO: 792108 - protein, 244 aa, Homo sapiens
MDKFPSVQHFFDSCDHLQKIQFPECVCLCLHSHFFSSPDLSLVCFVPRYEEEVALRATAENEFVALKKDVDCAYLRKSDLEANVEALTQEIDFLRRLYEEEIRVLQSHISDTSVVVKMDNSRDLNMHCVITEIKAQYDDIATRSRAEAESWYRSKCEEMKATVIRHGETLRRTKEEINELNRMIQRLTAEVENAKCQNSKLEAAVAQSEQQGEAALSDARCKLAELEGALQKAKQDMACLIREY

SEQ ID NO: 792109 - protein, 67 aa, Homo sapiens
MRPPRAPVVPPDLGGPRLCPVPAAGGARSPSSPYSVETPYGFHLDLDFLKYIEELERGPAACRAPGP

SEQ ID NO: 792110 - protein, 81 aa, Homo sapiens
GLGDTGQRCPCRLCLWLGPQGEGGNPRPAASYPELQATSSAPWHCTCTVGREGGKAGRGGGGRMSLEVGVLLQPWVSRCLG

SEQ ID NO: 792111 - protein, 59 aa, Homo sapiens
MENKFYAISDCKLRKFREKQTAATNHLHLHHRCHHLEWNCPHFCCCCKCTKIKTSLEDD

SEQ ID NO: 792112 - protein, 119 aa, Homo sapiens
PPLPSPARPLCDPRGARGLSLAGLRSPPQRSRGRACRNRAGEKALWRPLCTPSCRAQTGGVMWVYCLGLRQVAAASLGVFKDRESDAEWLKVTEDSAGRYVKIPSQGRNLEFPRMSRGL

SEQ ID NO: 792113 - protein, 115 aa, Homo sapiens [sequence omitted]

SEQ ID NO: 792114 - protein, 444 aa, Homo sapiens
LATNTHSCIIHAKATHAHSCIIHAKVTNTHSCIVHAKATNTHSCMVHVKATNTQSRMVHAKATNTHSCIIHAKVTNTHSCIVHAKATNTHSCMVHVKATNTQSCMVHVKATNTHSCMVHAKATNTHSCIIHAKVTNTHSCIVHAKATHAHSCVVHAKATNTHSCMVHAKATNTHSCIVHAKATHAHSCIVHAKATHAHSCMVHHNNNGGNNPRVHQQDTQNVVFLHSAVQLSHREGGSPLGSSAGSHEGPELTKPDTRATRGPVTFIRGVQNRSPRQKPLHVPRTSQRWRRAVGRPRGRARGGEGPWAGPVDEPEVEKGRGPAPWTSQRWRRAVGWPHGADEPWCHGSRFIKALKGSQCRGDGEEGLGRVSTSPGHLSFVEHSLRLAVGIPCESGQPGHRSCFLLARFSHRGTPHACTRVHTITHSDFTHMHLHVRPWQRHPTQ

SEQ ID NO: 792115 - protein, 76 aa, Homo sapiens
MKSSRCGWASICGTGAPRSGHWSRIRSARLRVPGLSSSSPQGMKKAKSTWPWYSLPAAQSYRIFLAAMVLPMPAGP

SEQ ID NO: 792116 - protein, 106 aa, Homo sapiens
MVCSQPGPDPQSQVPVTSGAAKPSPHRDLDTPGQDVGLDGPFSVLSLISTPATAYTHPTHAGTHSLCTHVFLARFHPPMTGVCEVQMDTAHTQTLHQAVTSLPLRP

SEQ ID NO: 792117 - protein, 567 aa, Homo sapiens
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTPRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 792118 - protein, 567 aa, Homo sapiens; identical to SEQ ID NO: 792117

SEQ ID NO: 792119 - protein, 883 aa, Homo sapiens
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTPRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRRLRDPPPPRGSLSSRFSWRNSDLGREESSSITHPDPKRLKARRSRVDPEALTLPAKGHGPRSPPPAPRAQLCAGHQKPQIMTAAQTVATGPWCSVKPLAPAWAHSRGHERVLLWLHHHTHRAAGAQLCHGSQPGSSRPVGWRSFRSCCTTAKGPGGPGACDGDNSAWRLLLRGSRATLDMRGLRPTPRRKCPVLRESSEGLQPGTKTQYGLNQAWSPGVRRDLIQGSAERPARYPAPGEMGVGAFIPLGHDRGEQPASICTSQAGKGLKPWEAEAPPSGNRSRPGSLTASDCPVDRNPQAPCARTGLMVETPHHEQWVRGEHYRYKFSRPGGRHAAEGKWWVRKRIGAYFPPLSLEELRPYFRDRGWPLPGPL

SEQ ID NO: 792120 - protein, 883 aa, Homo sapiens; identical to SEQ ID NO: 792119

SEQ ID NO: 792121 - protein, 555 aa, Homo sapiens
SAPSPHMRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTPRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHTTVHEHEQGDQGGGAEQSRIDRAEWPVSGPQARVTWQVRRRDGLPAAKDAVAKRRAHPSPKRTERLGRHHGAG

SEQ ID NO: 792122 - protein, 103 aa, Homo sapiens
SAPSPHMRPDSPTMAAPAESLRRRKTGYSDPEPESPPAPGRGPAGSPAHLHTGTFWLTRIVLLKALAFVYCECRAGPGHPPVSPPRTTTPALPRDSSARSRGR

SEQ ID NO: 792123 - protein, 165 aa, Homo sapiens
MQAETILEGLEAGLPQAVSSGLSLVPAPGLVLTCLSAPSGPGGMALEPPPTTLRKAFLAQSTLLESTLEGAPEWAAPRPEEQRRSPPACSQHTPPLPSTPTGPPPCSPGGNHPLCALSGRGGGRCSIPSLSSSSTFSLFSSGCWNPRVKLRVRKSQSQGRAGQLI

SEQ ID NO: 792124 - protein, 105 aa, Homo sapiens
MSRLYLLTKYLNGSKVIRITWADSLKYTFLDLTPGYSNSVQYKKCDSARLENLFVYGIFGLSSFFFSFFLRWSLTLSPRLECSGAISAHCKLCLLGSRHSPASAS

SEQ ID NO: 792125 - protein, 117 aa, Homo sapiens
LAFSPSHILKTSEGHCEIQHLSIFISDEWLRRQWVEEAGTAAQLASVHSCSLISFWDSYTQRTLSPNIMVLCSQNAVMQYSPGSYTDFSVNFNNNSYDSMLFKPKYYAEINIEKKLI

SEQ ID NO: 792126 - protein, 151 aa, Homo sapiens
MKTARIKPNAITYGYYNKVVLESPWPSSTRSGIFLWTKVRNVVRGLAQFRQPLKKTVQRSQVSSISALQNVTGGSDGDTVSHGSVDSSNDANNGEHTVFVRDLIRLESIDNHSSTGGQSDQGYGSKDELIKDDAEIHVPEEQAARELITKT

SEQ ID NO: 792127 - protein, 186 aa, Homo sapiens
RCYTNPPQWAKCLFSHCYSLWFICLPAYVRVSHPKVRALQQAYDVLIKMRKTDVDPLDEVCYRVVMQLCGLWGHPVLAVRVLFEMKTARIKPNAITYGYYNKVVLESPWPSSTRSGIFLWTKVRNVVRGLAQFRQPLKKTVQRSQVSSISGGQSDQGYGSKDELIKDDAEIHVPEEQAARELITKT

SEQ ID NO: 792128 - protein, 1564 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRALKLMSTSNTWCDLGINYYRQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792129 - protein, 1546 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792130 - protein, 1575 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKVGFFIQTEHYFELKAFLFGYRIDRCLLYKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792131 - protein, 1534 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792132 - protein, 1254 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792133 - protein, 1479 aa, Homo sapiens
SRGDSEYSLLVRNRTTLLSSYPGLPGTAHTHTHTKSYSGKCKLKSIIPSYWKKTLEIKRRQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792134 - protein, 1546 aa, Homo sapiens; identical to SEQ ID NO: 792129

SEQ ID NO: 792135 - protein, 1508 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEDLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792136 - protein, 489 aa, Homo sapiens
LEWHITPNHKRKEQEKKNDQQKQFENNKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792137 - protein, 322 aa, Homo sapiens [sequence omitted]

SEQ ID NO: 792138 - protein, 117 aa, Homo sapiens
PTTTKFAAANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792139 - protein, 1269 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLA

SEQ ID NO: 792140 - protein, 111 aa, Homo sapiens
FVCRTMPLGGGTDNFQATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 792141 - protein, 911 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHVRI

SEQ ID NO: 792142 - protein, 445 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKWEVL

SEQ ID NO: 792143 - protein, 334 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQEYF

SEQ ID NO: 792144 - protein, 1295 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKD

SEQ ID NO: 792145 - protein, 1196 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRAFQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKVK

SEQ ID NO: 792146 - protein, 419 aa, Homo sapiens [sequence omitted]

SEQ ID NO: 792147 - protein, 93 aa, Homo sapiens
TPKPRQAVSWKKKAARSPEWPGSCLISWTSSLGGYWIANKAELIKVNELRLHRRHGIQAPVCLGFHLPDGQRRGCSNTYPEWWGWGEKGKNAL

SEQ ID NO: 792148 - protein, 118 aa, Homo sapiens
MSTPEPRLSNPTSISRGDSRNRQNGTHDRRSAKAPRAEARVQPRPRGPPAAASRCRTLTQGPGAALLDGFVLAPGRLLLQLPQDFFHLDLPGAGPPPTGREARASRAGEAAAAWPWAP

SEQ ID NO: 792149 - protein, 130 aa, Homo sapiens
DTVNSSLFLEILSSLVFSVAPFAPVFLLFLCILRGSRGFCSWSSSFSICFRETCKSTTQPNMPVQVPDLKSSSLLVDPFISTRLEQNSCGSLSGLLISVNFTTKYPVLKQETLGFTFDSSLPLNAQISWV

SEQ ID NO: 792150 - protein, 110 aa, Homo sapiens
MTPEHPAIPLFLKSTSLPGRYPGLLLATFQDSVERSLPLVPGSLFHLTTSYGAFIFAWTCEFPEASFVSPAHCCTAKSWDGVATPQGFETSNQHSKSWRWGRHRGTRGEG

SEQ ID NO: 792151 - protein, 196 aa, Homo sapiens
KDLGYLQQWLKAFVGAFKKSISLSSLEPRRPEEAGAEVPLLPLDELHVLAEQLHQADLEQALLLLKLFIILCRNLENIEAGRGQVLVPRVLALLTKLVAELKGCPPPQGRGTQLENVALHALLLCEGLFDPYQTWRRQRSGEVISSKEKSKYKFPPAALPQEFSAFFQESLQNADHLPPITAVTSHPPLLRRPRWR

SEQ ID NO: 792152 - protein, 128 aa, Homo sapiens
YLGNFSVDWILSLPLLQPLLTVCSTTMTPILSTFFLIDMNILTLSPLPPMGSVFEKFRNPKSNHVWPKPFSPSNYMLEQNIILRVLHNIRGKFSPSFKQITLICPIFQRKNSNKNVKWEQMRTNFYTN

SEQ ID NO: 792153 - protein, 96 aa, Homo sapiens [sequence omitted]

SEQ ID NO: 792154 - protein, 234 aa, Homo sapiens
GEEAPRFPHLGSGRWEQEDRALSPVIPLIPRASIPVFPDTKPYGALGLEVPGKLPVTTWEKGKGSEVSVMLTVSAAAAKNLNGVMVAVAELLSMKIPNSYEVLFPESPARAGTEPKKGEAEGPGECGREALWDLRGVILVGGSDPLLSAGGKEKGLEGKSPDTGPDWLKQFDAVLPGYTLKSQLDILSLLKQESPAPEPPTQHSYTYNVSNLDVRQLSAPPPEEPSPPPSPLAP

SEQ ID NO: 792155 - protein, 208 aa, Homo sapiens
GEEAPRFPHLGSGRWEQEDRALSPVIPLIPRASIPVFPDTKPYGALGLEVPGKLPVTTWEKGKGSEVSVMLTVSAAAAKNLNGVMVAVAELLSMKIPNSYEVLFPESPARAGTEPKKGEAEGPGGKEKGLEGKSPDTGPDWLKQFDAVLPGYTLKSQLDILSLLKQESPAPEPPTQHSYTYNVSNLDVRQLSAPPPEEPSPPPSPLAP

SEQ ID NO: 792156 - protein, 204 aa, Homo sapiens
GEEAPRFPHLGSGRWEQEDRALSPVIPLIPRASIPVFPDTKPYGALGLEVPGKLPVTTWEKGKGSEVSVMLTVSAAAAKNLNGVMVAVAELLSMKIPNSYEVLFPESPARAGTEPKKGEAEGPGGKEKGLEGKSPDTGPDWLKQFDAVLPGYTLKSQLDILSLLKQVGLGEKKGWVLEKRGCRPGAVAHICNPSALGGKASESL

SEQ ID NO: 792157 - protein, 82 aa, Homo sapiens
STPPPALVELCPGSPWLFLCVCLSLSYLATFVHQHFHGNTPGQQVHPPEPLAPLSPIYLACKCVFLNLRATSGSPERCTLYL

SEQ ID NO: 792158 - protein, 335 aa, Homo sapiens
MLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 792159 - protein, 335 aa, Homo sapiens; identical to SEQ ID NO: 792158

SEQ ID NO: 792160 - protein, 335 aa, Homo sapiens; identical to SEQ ID NO: 792158

SEQ ID NO: 792161 - protein, 405 aa, Homo sapiens
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEATWLPCFPTSPAASSSTLSSMWALSGSSRCSSRTRPSSRASYSSASSQT

SEQ ID NO: 792162 - protein, 405 aa, Homo sapiens; identical to SEQ ID NO: 792161

SEQ ID NO: 792163 - protein, 405 aa, Homo sapiens; identical to SEQ ID NO: 792161

SEQ ID NO: 792164 - protein, 145 aa, Homo sapiens
HLTPSCSPAGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 792165 - protein, 128 aa, Homo sapiens
VVWGCSEHLDPRNPDLLTPVPSLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 792166 - protein, 136 aa, Homo sapiens
MFDTTPHSGRSTPSSSPSLRKRLQLLPPSRPPPEPEPGTMVEKGSDSSSEKGGVPGTPSTQSLGGHCWHGVSARHLPPAPPDGPTRGCADVGTTEPRCTLDQGAGPASGRPPTNLFCPAEVVGGASWGARFPQLWV

SEQ ID NO: 792167 - protein, 335 aa, Homo sapiens; identical to SEQ ID NO: 792158

SEQ ID NO: 792168 - protein, 335 aa, Homo sapiens; identical to SEQ ID NO: 792158

SEQ ID NO: 792169 - protein, 335 aa, Homo sapiens; identical to SEQ ID NO: 792158

SEQ ID NO: 792170 - protein, 335 aa, Homo sapiens; identical to SEQ ID NO: 792158

SEQ ID NO: 792171 - protein, 344 aa, Homo sapiens
MLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEVGGAARAGLGAAGLQGPVLKPHRAAGTSPLRISVSSSVK

SEQ ID NO: 792172 - protein, 334 aa, Homo sapiens
EKGSDELLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 792173 - protein, 405 aa, Homo sapiens; identical to SEQ ID NO: 792161

SEQ ID NO: 792174 - protein, 205 aa, Homo sapiens
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKVTEDPVTGPRGPPLSRPPPPNMQSPICSAP

SEQ ID NO: 792175 - protein, 125 aa, Homo sapiens
MLSPTYKQRNEDFRKLFSKLPEAERLIVDYSCALQREILLQGRLYLSENWICFYSNIFRWETTISIQLKEVTCLKKEKTAKLIPNAIQICTESEKVTEDPVTGPRGPPLSRPPPPNMQSPICSAP

SEQ ID NO: 792176 - protein, 67 aa, Homo sapiens
SWFNSGLECRLWNNNANPGSLEPLSIEDLVQVIQRLHCLPFLICVKCLEEYLSHNKSSITWSKCKKI

SEQ ID NO: 792177 - protein, 259 aa, Homo sapiens
LTLPSTQCILFLISLPMSQSRLPKGSQPGAVELSGLCLRSCVLTTVAAAPGGLRPAPLHTWAAGLPRASPQTSGEGSPRGREGSLMPISFRSLRATRPTDVGLSCLDVQFLWLTPQARSSGTEGGLWAPVDFHSQDFTSLPRASDRTATSSHECRAWTKLERQRRLWQGPSWKPWQARACMCWLARAYFGVCVGDTGLLRDWRGSRVGSSLVEARPGTHSVVQIPAPLPAVSTVSSPVKWEYLCGGRVLRFPRANLPAV

SEQ ID NO: 792178 - protein, 83 aa, Homo sapiens
MSPGVTFFAERRAHASVPWAVESQCSALLSAADLVPGDSLSKCSGDNVQWEAEAGEWHEAELAVSQDRTTVLQPGQQSEALSQ

SEQ ID NO: 792179 - protein, 126 aa, Homo sapiens
VADGQVLLVSRLGRSLGPAFPFSVPLLWLLDSLWNIPGDSWASRESGLQGVGPASPCLAGFPGQRSCCSPVIPPVLQPFSLVQTHTLPSHCLGLLSSPFWLEGLARALSPALPVRRAQVCGFGGAA

SEQ ID NO: 792180 - protein, 216 aa, Homo sapiens
PKNKLEKFWRFPTVWKTDELHSLGILKTLLTWALRPAELAPLYGCWGLRTGIAVACAPHHASLNLHGLNQIRNVKKQSVYLMNLRKSGTLGHPGSVDETTYERLAEESLDSLAEFFEDLADKPYTFEDYDVSFGSGVLTGKLGRDLATYVINKQTPNKQIWLSSPSNGLKRYDWTEKNWVYSHDCVTLHDVLAAELTKALKTKLDLSSLAYSGEDA

SEQ ID NO: 792181 - protein, 162 aa, Homo sapiens
AAVFCCGFRDHKYCCDDPHSFFPYEHSYMWWLSIGALIGLSVAAVVLLAFIVTACVLCYLFISSKPHTKLDLGLSLQTAGPEEVSPDCQGVNTGMAAEVPKVSPLQQSYSCLNPQLESNEGQAVNSKRLLHHCFMATVTTSDIPGSPEEASVPNPDLCGPVP

SEQ ID NO: 792182 - protein, 82 aa, Homo sapiens
AAVFCCGFRDHKYCCDDPHSFFPYEHSYMWWLSIGALIGLSVAAVVLLAFIVTACVLCYLFISSKPHTKLDLGLSLQTAGGS

SEQ ID NO: 792183 - protein, 159 aa, Homo sapiens
HPQVKGPGTGLWGISLGADICLSMASFLKNDSDTVSINGSGISGNRGINCKQNSIPPLGYDLRRIKVAFSGLVDVVDIKNDLVGGYKNPSMISMEKAQGPIIFIVGQDDHNWRSELYAQSLNGYGPMERKNPRSSVTLGLGFTLSLLTSPCAQLPFTNY

SEQ ID NO: 792184 - protein, 104 aa, Homo sapiens
AKLKRKCCLNVTAPFRKTQLVSVWVRSPRGHSPCVGRWHRVEATPVTPIPHLPVSATQADLHPMTQKGFVKIKSRVLCRGVCAHGGWDGGMGCVGLTEASAAGT

SEQ ID NO: 792185 - protein, 67 aa, Homo sapiens
SLGAGGAELGKWSPGESPAIARSFPGFPCGGRVCWVSELTRGPEVAKSWNSCPSAPGKGVKARPESL

SEQ ID NO: 792186 - protein, 80 aa, Homo sapiens
KYGLKSHSSLPYRLDSGGSQLAVQTPPAPVVGSAWTDHDHSQGAKRFGEIRAAAGTDSVRREPSTSQEVSSLQEQKLPAP

SEQ ID NO: 792187 - protein, 173 aa, Homo sapiens
AARREPQPSPPTRGARGPGSPRPGASREPGPGASRAPRGGRATMLKMAMKLKARAAESEKKTAAAAAEVAAEAAAAAAALAEPREPLAPRKSGDPEKLAKNPKNPAREALPEKFLTDKERKKLEKKLLEQRRKEEKKKEKERKKMEKMLKKKKKKVPEAQEEARCPEAAAAAA

SEQ ID NO: 792188 - protein, 173 aa, Homo sapiens
MCGGLQEWQGSGASSVKTEVTVSLAPPALPPRTGVFASVLISCWVLPWTLSGMQAGTSLLSSYIPPRAQGSVRGPATPWQGSCTSIISCLRAPDPPPGTTLVGLRLEGKECQNSSPGGRRVCEPSPALSDSQTFISSSFSWLEVPCIIFFFFFFRWSLTLLPRLECSGAMSAH

SEQ ID NO: 792189 - protein, 98 aa, Homo sapiens
PSQKTNNNNNKKKRASLQQFTQQPRQDLLETISILFPGLCQLLECYQHHQTLVVLVSSGSVLQDLFEPGNRLSCLWVPHLILGIHIWISGLHSFCSWM

SEQ ID NO: 792190 - protein, 116 aa, Homo sapiens
SGLGLSVAVLWPLCWAPSQKITHPWHLPGPSAASLHVKRSPLASRRYIYLEELLDFKVFCSGKEEGTSPHGPILGAPQTGIPVVTKDPARDGGTKSSLENTGPSSLPALRASYVRL

SEQ ID NO: 792191 - protein, 121 aa, Homo sapiens
LRHGIQYFNNNTQHSSLFTLNEVIVQTNCSKENFLVLTSDCKSLWNGDTGECTDNAYIDIQLRIASFSQNCDIYPGKDFVQPPTKICVGCPRDIPTNSPELEETLTHTITKLNAENNATFY

SEQ ID NO: 792192 - protein, 104 aa, Homo sapiens
MEKIHCRFICIKDLLRYPSMRKPLFHSFFILLAPDSLSEFQNLILMKYGTQVSGSDFDTVSPFPAQATPLTSLLVGTALLALPITALILHFLELNLAQQMLNES

SEQ ID NO: 792193 - protein, 70 aa, Homo sapiens
MGVVPAMNGVYYKCEFRGAIPASRTGDGGCVATDGPDPLGVKGKYGEKFPSPPGTAPIFVEFVIKASCSS

SEQ ID NO: 792194 - protein, 189 aa, Homo sapiens [sequence omitted]

SEQ ID NO: 792195 - protein, 114 aa, Homo sapiens
RGRDFGDLLIYSGALLVFLSLLGWILWYTGNIEISRQELERDYGLRPSALARLARKLSRRWSAPAAAGQRPAPGSRRARRAARAPPPPAAGSRRVRLQLATLEAGPGAAGAGSE

SEQ ID NO: 792196 - protein, 128 aa, Homo sapiens
RGRDFGDLLIYSGALLVFLSLLGWILWYTGNIEISRQELERDYGLRPSALARLARKLSRRWSPRAPAARHARGRARGGGRGQRVRPRQPLGSSCQDQTEMCSCPYIRGQTDAPCTPSLLTWIKSRFAL

SEQ ID NO: 792197 - protein, 112 aa, Homo sapiens
RGRDFGDLLIYSGALLVFLSLLGWILWYTGNIEISRQELERDYGLRPSALARLARKLSRRWSGRGQRVRPRQPLGSSCQDQTEMCSCPYIRGQTDAPCTPSLLTWIKSRFAL

SEQ ID NO: 792198 - protein, 112 aa, Homo sapiens
MQLALLPVPINQTPPHSVSEFSIGSSASADINAYHCCVHVSSPCTLQAPLSFTYPSPCMRSGASNQIQPEGTSACACCSQEKRQPVLGGAPSLAHPLVLKQKARINYLKAKE

SEQ ID NO: 792199 - protein, 112 aa, Homo sapiens; identical to SEQ ID NO: 792198

SEQ ID NO: 792200 - protein, 129 aa, Homo sapiens
REKQSFEAELIKGTSTNNPSHGGGGVFEDPMRASNKGESLEQIIVVKWRQRASNVSGIGGFLVALTSRMKPRTLTVVSLVAVHPSTVNMLGKQLCQKPSDSPASTPQAKWRRKICASFSQGILCLWGTF

SEQ ID NO: 792201 - protein, 76 aa, Homo sapiens
REKQSFEAELIKGTSTNNPSHGGGGVFEDPMRASNKGESLEQIIVVKWRQRASNVSGIGGFLVALTSRMKPRTLTV

SEQ ID NO: 792202 - protein, 166 aa, Homo sapiens
RRPLSLPSPNRDPASQNHRHSHLWRRRGPTDPRRRGRAAARPSAPSQPAPAHPAPPARHGDLYGPPPRRPSKGPRPWVSRAGAPGQSWRRQGRDRTVGPARPTADAEPASGLGAGLTRPRKGPAPRGPQTGRPARQTDRLTPARGSRRSGCAGPATAFWPQAAPQG

SEQ ID NO: 792203 - protein, 107 aa, Homo sapiens
RYLIPLVFFRPSQSALPLLRPYTQKELRRERPRLPTAKPILLPAAASPSWQEKCRLFLWLHADPSLELPSRPCLRLSLTLFSVLGHHPLPHSHLPLDPIHPPGPTNE

SEQ ID NO: 792204 - protein, 130 aa, Homo sapiens [sequence omitted]

SEQ ID NO: 792205 - protein, 113 aa, Homo sapiens
YSRTTGQCPRLFSLHNAPAPVPLFLPNSPAQWREAPDTAGMVGARNLVGWSMFPGDPEAAGPTPQTSGALVVQTKTDASLSYPPRLSLLELISGLRKKALNSTPDTRMTSAFK

SEQ ID NO: 792206 - protein, 206 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLPHAQKKWYMSGEK

SEQ ID NO: 792207 - protein, 230 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLHFLLSFVQIFLSFLLFIVPSSLSVLYFFFVYKDFLKR

SEQ ID NO: 792208 - protein, 229 aa, Homo sapiens
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLPHMGWFSTNQICFTACIAFRCSRSEKVVHVGGEMSA

SEQ ID NO: 792209 - protein, 114 aa, Homo sapiens
GFIGETQEEDGTAYSGTAFQVERGAPGLPQKSLESLGYRQDSKSSELQLQEDVKCKQTGELAPEKHSIYLLIYLALGLNSGGTQEYFLQSDIWLLVGPSVITSAEGLKGALRVI

SEQ ID NO: 792210 - protein, 123 aa, Homo sapiens
LQRRKLSSGTWNLSKVTQLQAHWHRAWPTVCGVDPNQCCAGNHSWLPKRRPGASGHVHISSSASAASPSLERAALISGYPLPLRAPACPISWNERQLPGSGVYLFPKQALCLERASSRSLSHQ

SEQ ID NO: 792211 - protein, 97 aa, Homo sapiens
RHLQLSPARPSQLGTGKEQGKRNEKTWGRIHVFSWFPSWNICKFFSFKEKLSSQWAIKPTFIIQFNLIQNTLIRQLLYAEHMTKQKNHSSGEKNVFL

SEQ ID NO: 792212 - protein, 121 aa, Homo sapiens
GISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 792213 - protein, 126 aa, Homo sapiens [sequence omitted]

SEQ ID NO: 792214 - protein, 88 aa, Homo sapiens
QPQLAGFRPGRLHLEAWGSCSYGTEASWEILGGSLPLSLDFNHTMRTYNTINLLSELGQKSEQAARDRAHLTNGYPSLCLAQSLAHSC

SEQ ID NO: 792215 - protein, 103 aa, Homo sapiens
LENERVGRHAGQKVVAKNCCDEPMRAETGLCFGIYSTSYSIMTLEGGMESLPTTEEARSEFGHAGGAAAGVWTPTTPPQPGACGSSQETPWGRHPAASGGHHQ

SEQ ID NO: 792216 - protein, 117 aa, Homo sapiens
MVSHSVPQAGVQWRNLGSLQPPPPGFKKFSCLSFPSNWDYRRTPPAQLIFYFYFFLFFSRDGVSLCCPGWWCVPVVPATQETEAGELLEPGRWSLQRAKIVTLHSSLDDRLRLHLKK

SEQ ID NO: 792217 - protein, 117 aa, Homo sapiens; identical to SEQ ID NO: 792216

SEQ ID NO: 792218 - protein, 68 aa, Homo sapiens
MTTLSGSVPHCSKWLLRLSSVVSKLNPPMKSFLSCSGSLGDSDLDKTARRRETLMMLLPWHPWAERHK

SEQ ID NO: 792219 - protein, 114 aa, Homo sapiens
MRHSADSPEQPTPTRTHPGRGNPLKTSGVLIPHLQLDKVPPWCRGKAAAIFLVQEKEQASPRLQPVGLWSTVGTPRWGERKTSVLSPLPVPPLPGVWLEEERKRTGVGRDAHHI

SEQ ID NO: 792220 - protein, 108 aa, Homo sapiens
MVASLLFSDLGFLASRISKNGFLTHAVRCYPSIQLDEDELGALSPRRNNGEPLARLGAAVGAASLGQKCSRHPAGSRGVKSAAGLRQRQTAVVDSEQKLSSSSNKYGP

SEQ ID NO: 792221 - protein, 115 aa, Homo sapiens
MDRSCTGGDSHQSATDSGALPTLSLLREKQAAVIFVCSFCAGKGVSRGKLWYLSPQTTTSVLSWPDCTRPIKRSRGEIEACSSGSPIKVGAVVTLTLSLPREKLRAEILHQFTLC

SEQ ID NO: 792222 - protein, 136 aa, Homo sapiens
RISRRRAAAFPGRLGLARSGSPRCRDGKCLPTAGLGTHSRALQAPELFLGKGVNEAPAQPLSFSWHFPVNPPGVQVGHFPLPGSALGLGLRPVPSLQSAVQSRWGWKGSGLLPSQVSSSAWAATRLDLSAHYMDKP

SEQ ID NO: 792223 - protein, 105 aa, Homo sapiens
MYHHVSRSCMILELWVVFQFFIMIKNAVINIFAWSIFAHLAIYVQLQEMLGEREHVYKNVMSQAWWHAPVIPAALEREEILTRVPAFLVHKLALVLPGAGDHQVT

SEQ ID NO: 792224 - protein, 92 aa, Homo sapiens
LLQVCFPLWMPDIENVTHAVLFHILQAPPQLSSGMRLGSMDLFSLAFVLMLPAVQGAARAPSHGSFPPSGTAVTGWHGCQSLAGPSVVETTL

SEQ ID NO: 792225 - protein, 92 aa, Homo sapiens; identical to SEQ ID NO: 792224

SEQ ID NO: 792226 - protein, 567 aa, Homo sapiens
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 792227 - protein, 567 aa, Homo sapiens; identical to SEQ ID NO: 792226

SEQ ID NO: 792228 - protein, 458 aa, Homo sapiens
MPTILWLMDWSDMNSNLDLLALLGLGISSFVLITGCANMLLMAALWGLYMSLVNVGHVWYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 792229 - protein, 474 aa, Homo sapiens
RITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQNVYAFLQTKVPQRSQKASVTPGGEMCELFNSKMGKPPESLHLEAAYPKTSSMYEFFENYYYFYFYMINKDTKDVPNDTDTKMHRLKSSRCVVCKLSSKTFMESERLTHLLEHITQSIGSSTKLRGPLTYRGEHYTNYAGQGPTRVTMPREENTEPHIGPDWIRKNKHHGARARQAHTAPTRSNKKTDKKYSRHQGGVHKPERRRNTRDNKRNKDRQTRTARQARRREREGQRRTVRAGTVLCMGRGEEEGASGGRRTQTAGGSARRRKAGYTSERKGAKEARGMKEGRGKAGQTRQGGRQRTRAQRTTDSG

SEQ ID NO: 792230 - protein, 491 aa, Homo sapiens
RITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIGPMYMLSYKLKFHKEARKLQLLHEETCVNYSIVRWANLLVLAFRSCLSKTSSMYEFFENYITFDFYMINKDTKDVPNDTDTKMHRLKSSRCVVCKLSSKTFMESERLTHLLEHITQSIGSSTKLRGPLTYGAEHYTNYAGQGPTRVTMPREENTEPHIGPDWIRKNKHHGARARQAHTAPTRSNKKTDKKYSRHQGGVHKPERRRNTRDNKRNKDRQTRTARQARRREREGQRRTVRAGTVLCMGRGEEEGASGGRRTQTAGGSARRRKAGYTSERKGAKEARGMKEGRGKAGQTRQGGRQRTRAQRTTDSG

SEQ ID NO: 792231 - protein, 70 aa, Homo sapiens
GVVSWGYGCTLRDFPGVYTTSRSTCSGSCSKSGSCPEQAGLGSHLGRLRRDQDLPPPSDLRFGLRCRPPS

SEQ ID NO: 792232 - protein, 62 aa, Homo sapiens
MAPPGPANPAKQSWTQKQTPWPAKLSLQNPSLQLFRKIDLSNNSIYHVARLASMIKLYCNAV

SEQ ID NO: 792233 - protein, 78 aa, Homo sapiens
QPNNAQAIHSSCPCKCQRQPSQKSLKPTKPEDCAVPLSPTFSPSTLRNLATVSPCGQAWNITSVRCNLWISYETERKE

SEQ ID NO: 792234 - protein, 76 aa, Homo sapiens
QPNNAQAIHSSCPCKCQRQPSQKSLKPTKPEDCAVPLSPTFSPSTLRNLATVSPCGQAWNITSVRCNLWISYEMDI

SEQ ID NO: 792235 - protein, 68 aa, Homo sapiens
QPNNAQAIHSSCPCKCQRQPSQKSLKPTKPEDCAVPLSPTFSPSTLRNLATDGYLRASELSLPPSIIS

SEQ ID NO: 792236 - protein, 147 aa, Homo sapiens
TAKQCAGNPQQLPLQMSAPAQSKELETYQAGGLCCASLAHIFPKHSQEPGNSVPLWPSLEHHICTLQSVDQLRGKSLFGRGGGLCWTCLPKSMKSGSQGSEWRPFLPYHLNKNFTLAAGLNLWVGAGDFRCCCFKAAAKAMFFKVVS

SEQ ID NO: 792237 - protein, 321 aa, Homo sapiens
MTLWCQGTLDTQGYYLTKEGNPMTWYQQSPPEPRNKTNFFIPSMREHHAGRYHCHYLSPAGWSERSEPLELVVTGVSRKPSLLTLQGPVVAPGENLTLQCGSDVGYDKFTLYKEGGHDLVQGSGRQPQAGLSQANFTLGPVRVSHGGQYRCYGAHNLSSEWSAPSDPLSILIAGQIRGRPSLSVQPGPTVASGENVTLLCQSREQLDTFLLTKEGAAHHPLRLRSEHQAQQHQAEFPMSPVTSAHAGTYRCYSSRRFFPYLLSHPSDPLELVVSGAAETLSPSQNKTDSKTASHPQDYTVENLIRVAVAGLVLVVLGILLL

SEQ ID NO: 792238 - protein, 365 aa, Homo sapiens
MVSILTVLLCLRLSLGQKAQALAGTLPKPSLWAEPGSVITWESPMTLWCQGTLDTQGYYLTKEGNPMTWYQQSPPEPRNKTNFFIPSMREHHAGRYHCHYLSPAGWSERSEPLELVVTGVSRKPSLLTLQGPVVAPGENLTLQCGSDVGYDKFTLYKEGGHDLVQGSGRQPQAGLSQANFTLGPVRVSHGGQYRCYGAHNLSSEWSAPSDPLSILIAGQIRGRPSLSVQPGPTVASGENVTLLCQSREQLDTFLLTKEGAAHHPLRLRSEHQAQQHQAEFPMSPVTSAHAGTYRCYSSRRFFPYLLSHPSDPLELVVSGAAETLSPSQNKTDSKTASHPQDYTVENLIRVAVAGLVLVVLGILLL

SEQ ID NO: 792239 - protein, 160 aa, Homo sapiens
VTWSPLSPPGNGGWGALGRGVRDPEEEARARWRGGRGGVESARDGKERRGSGGARLGPRLPDSQPPGPGRGERSEDRGQGEREGIPGDRGRSRHPLLGSRSPKGSEMLPFDVYARGEGGMPRSRLTAGSGLPVPGIPGGKRGGSGDGTGDPRRLSSHPAA

SEQ ID NO: 792240 - protein, 110 aa, Homo sapiens [sequence omitted]

SEQ ID NO: 792241 - protein, 132 aa, Homo sapiens
MHLQKTDCLGLMRVGVQQDRVFQLHCFSLGQEAQTQGDPIPSLGHPTSLEYRQGPGSIKTVPQPLELRPDCLISICLLREGSLQPAWARCCPGENGILESSNLDPCQFIVASTLACLGKGLVLPCPHTSLPA

SEQ ID NO: 792242 - protein, 54 aa, Homo sapiens
MVHPSHSTPCSLTTQCPPTGGHPASEAVAASEAVADIRSSCRHPKQLPTSEAVA

SEQ ID NO: 792243 - protein, 147 aa, Homo sapiens
MNESWAGPGPAERAEEAVSGVGVEAKTQHAGQGAQPGGMGCGFSSGPIGMALGLGLVGTAATRGGSSAWPDSTCNVGRQWAPPGGRNTVRSMQRAGDHGACDLRAHPGQTWVRGGLGRQDGEGLQGVFVLCPYTGDLHGRVRSIRML

SEQ ID NO: 792244 - protein, 103 aa, Homo sapiens
IKTPTFNITLMSEQVIRIRSCVKPPYMLLVGNIIIIPNTQNIECDNCKLFMCIDATFNPTTSILFVRAREGVWIPVSLHHPWESSPSIHIVNEVLKGILKRTK

SEQ ID NO: 792245 - protein, 108 aa, Homo sapiens [sequence omitted]

SEQ ID NO: 792246 - protein, 190 aa, Homo sapiens
YILYTLVFAFSKYQHKNLLILYDAIGTLADSVGHHLNKPEYIQMLMPPLIQKWNMLKDEDKDLFPLLECLSSVATALQSGFLPYCEPVYQRCVNLVQKTLDLLSGLAEGLGGNIEQLVARSNILTLMYQCMQDKMPEVRQSSFALLGDLTGTNLNPEFISVCNNATWALGEISIQMGIEMQAYIPMCTSL

SEQ ID NO: 792247 - protein, 67 aa, Homo sapiens
LRPKATTRSLPGCLHYSTPDCRHRHPRLCLQLKSPSLPCPITEVIGSPAPSLTGIKGSGLVSMAPHG

SEQ ID NO: 792248 - protein, 225 aa, Homo sapiens
KLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEEIKESVELPLTHPEYYEEMGIKPPKGVILYGPPGTGKTLLAKAVANQTSATFLRVVGSELIQKYLGDGPKLVRELFRVAEEHAPSIVFIDEIDAI

SEQ ID NO: 792249 - protein, 41 aa, Homo sapiens
MTRNVVRQEFEAPGKPQDSSQQDACLILVKGNWTTNEMEVK

SEQ ID NO: 792250 - protein, 41 aa, Homo sapiens; identical to SEQ ID NO: 792249

SEQ ID NO: 792251 - protein, 105 aa, Homo sapiens
MGITAGCWEHPPWGVESLQEKSPPGPNTPLGCTVAYDSDKPHSAASSWPGSTCGLGHVSTPWGSLPPTWLPTPQSFLEQQCAQGTWGSFLQSLTEIVTQIILFCR

SEQ ID NO: 792252 - protein, 113 aa, Homo sapiens
DLGMLSTGPLGPLLFSHVFSPFQTCPCLEAGDPIHTAVPGILPGQCIAGNHLCPGCLSTQEAMTLQRQGKGSAGSPALLPPHHPRRGPACPGSLDMGFQWAITAISRVAKFLD

SEQ ID NO: 792253 - protein, 56 aa, Homo sapiens
EIAPLHSSLGDSTRLRLNKTKQNKSESQHCRYRTKFAFLGLTFLVSWIADSWSKAH

SEQ ID NO: 792254 - protein, 72 aa, Homo sapiens
PRSVTALSFPVAAVVGSYLFSCRRSSDNRPLQEGLLPPLHTASLIYGILRALAAAVGFEAPGLSPSQEGPQC

SEQ ID NO: 792255 - protein, 127 aa, Homo sapiens
AGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKVSL

SEQ ID NO: 792256 - protein, 156 aa, Homo sapiens
MGIVQQFLVLLTTSSDESLRFLSFRLDFNEHYKAREPRLRVSWVPGGGAAPTREARGPPRELRVMFVALLDTKFPLTSCRNCMLQVSCPSAHECAMFQRSGVWEKPRRVAHVGVECICKSLSQVGWLHCSHLSLKVFIPKRYHNLLRLLNLKCSKL

SEQ ID NO: 792257 - protein, 106 aa, Homo sapiens
MTCLSLLSSSPSSLCLVLFRHLLLGTFDFSHCRAAPTKDDCPVFVALRSSQNPLHLPPTLRHSKQPGFVPVRKRFLSSSYFFEQNILHTEARSSCKSDFVPNYLRL

SEQ ID NO: 792258 - protein, 45 aa, Homo sapiens
LIALIGIFSTMWNKSGEGKHPCLVLDLREKAFIINYYVSCGFSID

SEQ ID NO: 792259 - protein, 147 aa, Homo sapiens
PREGADCLWAEPGFSDSSSLSPWGVSSSGPPTPQGAHEPAGYVALQPAQCCFKLPLESSSVGTAWGPLHSQAARRRCESAQTLEARRGPGLPAGSTTCLGQGPAKSTVTGRQGVEQPLFCRQKQANFLKEEVPALAGGARFITPSFL

SEQ ID NO: 792260 - protein, 455 aa, Homo sapiens
VVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSDMVSNIELPTRIHEEVYFEPSSSKDSDENSKPSVDTEGPALVEIDRSVENTLLNSQMVSTDNSLSSQNYISQKEDASEFQILKYLFQIDVYDFMNSAFSPIVILTERVSLPFKPFAIILPILLNIRVATKYV

SEQ ID NO: 792261 - protein, 106 aa, Homo sapiens [sequence omitted]

SEQ ID NO: 792262 - protein, 112 aa, Homo sapiens
MGTTGNRLFLVSPSLASAASHLHSAPGRVWRLLEHGRPTSVPVGPRPRLDFEPRTPGPPLEGCAGPREVWDLDSAGAGSQGLVKETAGTPATAMAPRKDDLEQALRAVCTSA

SEQ ID NO: 792263 - protein, 106 aa, Homo sapiens
GHIRREGGVGSCSGAGTGDPRPPRSDGSDLSPSLSPCPRAVEAGYIFQKPNCKQLWRCQNSPPSDTALRRRFPQAGLFLSFPSAFLGDDKRLCSGNRNLEKKKKLR

SEQ ID NO: 792264 - protein, 128 aa, Homo sapiens
RWWERSTFSKEAYELISLQHFIMKKMQTRKVIFGFVKLGSTLASSKKRCQVSYCIVESGAWQRCVGCKYTFLSCLWLPNLLSNYFLKKASLSCPCKLAVCPMLLRSSIVSHNYKLVFSYVMSVFLSII

SEQ ID NO: 792265 - protein, 150 aa, Homo sapiens
GCGEIGTLLHCWWDCKLVQPLWKLVWRFLRDLELEIPFDPAIPLLGIYPKDYKSCLLAKFLSLNVLFIQDASLLFDTCGSVVSLASSFFLVVVTVKFGSVKGFQKCLPVISTYKQIKGNILLEVSQFSVLRHLPCLCHIYTVVPYSGDSI

SEQ ID NO: 792266 - protein, 164 aa, Homo sapiens
ISAHCNPHFQGSSNSSALASQAARITGTRHHARLIFVFLVETEFHHVGLKLLTLGDPPVSASQSAGITGESPHARPGSAFFPGPVTLLDVPWAPEGSVRCSAHLCCPFPPHPIHWAPGAPTPLQVSSWTLLSLHFCPRRPGRLMGTGIIFSSTVHCLMHESAGL

SEQ ID NO: 792267 - protein, 113 aa, Homo sapiens
NYTLSSGIHVQNMQVCYIGIHMPWWFAAPINQSFTLGISPNAIPPLAPNPSTGPRCMMFPSLCPCVLIVQLPLMSKSMQCLVFCSCVSLLRMMVSSFIHVPAKDMNPSFFMAA

SEQ ID NO: 792268 - protein, 79 aa, Homo sapiens
PLGAQRRLDRHGPRGCFPDVFVPGASAWKSAFVATLPLLLVLAALALGVLRKQRRSREKLRKQAEKRQGCVQISTFELR

SEQ ID NO: 792269 - protein, 220 aa, Homo sapiens
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGEMEKKMKILRESTEELRKEIMQKKLEIKNLREDLASKQKQLLKEQKELEEL

SEQ ID NO: 792270 - protein, 69 aa, Homo sapiens
DPVIEFRRLRGVNGLCTSQIILQNNNSSERGDEAAGVPTVLCWPLGVTVRSRPASSTVVLGRMSSPSLG

SEQ ID NO: 792271 - protein, 71 aa, Homo sapiens
GALSEQGCYMQDPLVSIDLSEWLRIIGFFLKGSRNEASHKMILLNNCQMLLALYESLAVSIPESLKVFKKV

SEQ ID NO: 792272 - protein, 127 aa, Homo sapiens
LKVEKGETSLQSSETHPPEVALPPVGEPPALENSTALLEGVNTVVVTTSAPEALLASWARISARARTPEAVESPQEASGKRNMKSLFWSNGEISLVDINHWYILGYIKIPLRAGDSWTLPTEFLVQV

SEQ ID NO: 792273 - protein, 92 aa, Homo sapiens
DEVPDRMGMEDIVEANYEFASFAFLRMEDRCRGGNKAGGSHTSSSILGLEFTPAIPTPRPLARRTSHRAMPVFKQQRNVKHVGSSICLRHPG

SEQ ID NO: 792274 - protein, 99 aa, Homo sapiens
PWMQCYHRGARGRGRLWHPDDKSGDSAVERKQNHPGMQRYHPGARSQGRLSHPDDITKSGDSAVERKQDHPGMKLYHPGARSPGRFWWQDGSTNLEIQQ

SEQ ID NO: 792275 - protein, 279 aa, Homo sapiens
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIYETLWKKKSLFEEVPWMSAPIQVGLVGSVGGC

SEQ ID NO: 792276 - protein, 261 aa, Homo sapiens
MSGELPPNINIKEPRWDQSTFIGRANHFFTVTDPRNILLTNEQLESARKIVHDYRQGIVPPGLTAGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIYETLWKKKSLFEEVPWMSAPIQVGLVGSVGGC

SEQ ID NO: 792277 - protein, 270 aa, Homo sapiens
MSGELPPNINIKEPRWDQSTFIGRANHFFTVTDPRNILLTNEQLESARKIVHDYRENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIYETLWKKKSLFEEVPWMSAPIQVGLVGSVGGC

SEQ ID NO: 792278 - protein, 510 aa, Homo sapiens
MLTRNPKTKSSLQILQDSVKWHHMAHKVNSLLDAYSGLLSNESMILAVNSSFVDPLLQFESQLKIIESSFGMLVVMPSLDKVKEMGSSYEYIEDMENLYHNILNIYENILTSLVSKDLYKLQILKEMLVWMSKDSSYLQERIMVIINKVLRFTVTKVRKYLSVDAPCLGLLAAELSLLCSHEDPSIVKQASLGMCHLLYIARCQNDIGTNKPTNGKSHSLQFPSSDVEFLPKEFQQDESKIAQRVGQTLLPPLLTDFVQSLLMKLSSPDDKIASDAASILIFTLEFHAEKVTMVSKIVDAIYRQLCDNNCMKDVMLQVITLLTCTSPKKVIFQLMDYPVPADDTLIQMWKAACSQASVAPHVLKTILLILKGKPGEMEDTVTEGKRFSLDITNLMPLAACQALCTFLPLGSYRKAVAQYFPQLLTTLMFQVFYNSELKPILKDRALYAQDALRVLLNCSGLQQVDITLMKENFWDQLSEDLCYYHGVCFIAKTLSEYNFPQFPETLKLSL

SEQ ID NO: 792279 - protein, 111 aa, Homo sapiens [sequence omitted]

SEQ ID NO: 792280 - protein, 63 aa, Homo sapiens
SKGSGGDGGSKALTIEAPPSLRTSGNGDRDHLPGTRKPPSPSWANLAAYSVFFRNPTDTSVNS

SEQ ID NO: 792281 - protein, 126 aa, Homo sapiens
RIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 792282 - protein, 138 aa, Homo sapiens [sequence omitted]

SEQ ID NO: 792283 - protein, 166 aa, Homo sapiens
GRQPRARAPREAELGGTRGGRALQVAAAAAPARPRQVRRSSCTFGSARAPLSSAPSGVSLWGGAFPPRQGLALDWRLKPWDPGAEGAKPHLPARSPLLWSQTIGRLGLKREGGAMGENPSPGVEPGPGGITCGGGSSWGSSGVRCSRSLIHLLNSINTCLLQAYHV

SEQ ID NO: 792284 - protein, 143 aa, Homo sapiens
FFILPGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 792285 - protein, 172 aa, Homo sapiens
QGLPEVAQWGWQSWGSGHFPSGGLGRWALSPRVPPTRGLVASDSLSTRLHHSPAVSPSGSLCASLSVSPPPLSAAEVPLRARAKRPVNHQSWDSGRVSVLLSLSSCRIRHEHFLNFTTVSPCGTGKSKSKKPVRGWWEMGSPYGPVSQENRVQRQGTSGHIRLEPYQEMLSP

SEQ ID NO: 792286 - protein, 177 aa, Homo sapiens [sequence omitted]

SEQ ID NO: 792287 - protein, 119 aa, Homo sapiens
HLRPGESGCDRFLWEPKAHLRQEARPALGRDHQHLILTRLTEHCVPCVVNKDAYCVCGWLWRLPWGSQALPLTLSLGSSGSPRTSGSVPNHTMPPVACFQRSFPAPTHTLCNILNYIYL

SEQ ID NO: 792288 - protein, 124 aa, Homo sapiens
GPPGRLKREGQRTDMRRRHTGTQGGGFPKGELAGHGLCPERAEEVTWPWGGFGGILVGAALGEGRGAVKREAVKALATRERGTRGRDRGAGSRKVLFLSGNNFLIFKCFSLNQKVHLYGSKFKI

SEQ ID NO: 792289 - protein, 57 aa, Homo sapiens
KGEKLPGPVPSRSSAPSLVHPEHQLGATGAVSLRPASAACGEFPWVHDSLPCPCGQE

SEQ ID NO: 792290 - protein, 458 aa, Homo sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 792291 - protein, 165 aa, Homo sapiens
PGLAEAADGPDRQPLTSGPRPPGLAFGPPGQCLRRGLGDGPGATSAEAARKALSPRGLARPESLARAHAAAAWAFRASAGPRALPGQAPLRPWLPASLAGLQSLDPACRARGGAAATAEAERDPPNLRATAGRQRTASRATCPAGPLKKSCARRPSLRTRTAPPA

SEQ ID NO: 792292 - protein, 113 aa, Homo sapiens
SLFSNAFLPAIAKSRECMCPALGQVICGVAERALGCSGRIGRSRFELHLTWISLLVRAWADELPWVQCGNEINTVCLTWLRSAASPAQQALPTDPQPTLQFAPKCSPCLNPCG

SEQ ID NO: 792293 - protein, 120 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEANLMN

SEQ ID NO: 792294 - protein, 125 aa, Homo sapiens
MEDKLKAANIQTSESETRLYNKCQDLESLIQEKDDVIQNLELQLEEQKQIRIQEAKIIEEKAAKIKEWVTVKLNELELENQNLRLINQNQTEEIRTMQSKLQEVQGKKSSTVSTLKLSEGQRLSS

SEQ ID NO: 792295 - protein, 190 aa, Homo sapiens
MAELSEPEGPVDWKERCVALESQLMKFRVQASKIRELLAEKMQQLERQVIDAERQAEKAFQQVQVMEDKLKAANIQTSESETRLYNKCQDLESLIQEKDDVIQNLELQLEEQKQIRIQEAKIIEEKAAKIKEWVTVKLNELELENQNLRLINQNQTEEIRTMQSKLQEVQGKKSSTVSTLKLSEGQRLSS

SEQ ID NO: 792296 - protein, 102 aa, Homo sapiens
MPEQDKPFSCCGVGLRLQSTPSRMPWCAGGSRTPQHALSSDLTVIQAGSLALASSICLCPAHLCPLLPPSQLCPPSTHAGSPTFPFYSPPHLSLPTPGVCKF

SEQ ID NO: 792297 - protein, 80 aa, Homo sapiens
EVSPEADATMLPVDSLQSREPINLISYKLPSLGYFFTAMQERSDIALYYLHVLKEDGIGPGVVAHTLNPNSLGGQGGQIT

SEQ ID NO: 792298 - protein, 119 aa, Homo sapiens
MEDEQLDSLEGWAPGPARPLRRSREAPAALPGGVEWRGGQVSCDLSRPHRAAAAAARGGPAGAGAQTQGRCGALAGKRTRASRVAPPPGMALECTESSVIIGYLIIITIIEAWLAAARH

SEQ ID NO: 792299 - protein, 129 aa, Homo sapiens
MKRTWRREAPNGVALCQLTSLFQGLQLGHPKTGQVTAHRRRGVLPFTSGSPMSAPAVFCPRESSEGGDCKHRDAQAPRRPSSCRSEKDWTPFWDCSTRVATPPGWIRIPVIHLLALWTTRPLACFPSLY

SEQ ID NO: 792300 - protein, 110 aa, Homo sapiens
VAQAGLQLLGSNDPPALASQSAGIIGMSPCAWSIFILMNRLKHLWGWGDKVKICRAGRQAGDLGYSGCCSSSLESFCQRPSRPSTDWTRPTHTLEGDLLYSKSTDFGLAE

SEQ ID NO: 792301 - protein, 101 aa, Homo sapiens
MNGRRRSPSALSSGPVPTARRWLAEAGARRGISGRAVKQGLLYRGLFFAAVSSPVAARPPPPLSSRARSARRPRAEARGRGGGAVSRHARRRCRSRDGKAA

SEQ ID NO: 792302 - protein, 192 aa, Homo sapiens [sequence omitted]

SEQ ID NO: 792303 - protein, 135 aa, Homo sapiens
LGLAGTAVGGEKPGGLGAPAGIGSRLGCERFSRSREILQAITMSTDTGVSLPSYEEDQGSKLIRKAKEAPFVPVGIAGFAAIVAYGLYKLKSRGNTKMSIHLIHMRVAAQGFVVGAMTVGMGYSMYREFWAKPKP

SEQ ID NO: 792304 - protein, 95 aa, Homo sapiens
SDWLGRLWVGRSREDWVRLQGSEAGWGVRGFLALGIAGFAAIVAYGLYKLKSRGNTKMSIHLIHMRVAAQGFVVGAMTVGMGYSMYREFWAKPKP

SEQ ID NO: 792305 - protein, 106 aa, Homo sapiens
MKFFLREILQAITMSTDTGVSLPSYEEDQGSKLIRKAKEAPFVPVGIAGFAAIVAYGLYKLKSRGNTKMSIHLIHMRVAAQGFVVGAMTVGMGYSMYREFWAKPKP

SEQ ID NO: 792306 - protein, 56 aa, Homo sapiens
MFMVCTEQWTFEIGNFLAGLIDVMELGTQGIICELASVAYMMCTMGREEPGSTSER

SEQ ID NO: 792307 - protein, 116 aa, Homo sapiens [sequence omitted]

SEQ ID NO: 792308 - protein, 140 aa, Homo sapiens
AKSRPTIPMLSFPAFLGHPVWLPGMDGPGLEWWSGEDNWGGLADDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 792309 - protein, 94 aa, Homo sapiens
SPGPGDHEFTSVISVSMTNPTGAAHSRIPHPRPAPSAMPPTSQPEVGTATLGRTEGAVATGSLRLTEESEARRTMELGPALGTKHSPFAAAEPS

SEQ ID NO: 792310 - protein, 190 aa, Homo sapiens
KPAARTSPTVATQTGASATSTRGTSPTRSAAPGARGSPPRPPPPPPLLGTVSSPSSSPTHLWTGEVSAAPPPARVRHRRRSPEQSRSSPEKRSPSAPVCKAGDKTRQPSSSPSSIIRRTSSLDTLAAPYLAGHWPRDSHGQAAPCMRDKATQTESAWAEEYSEKKKGSHKRSASWGSTDQLKEVRKMVLR

SEQ ID NO: 792311 - protein, 483 aa, Homo sapiens
DEFSRIPRTISSPAATQASVPDDSSSRRCSAPGASPKERHPDSRQRERGGGPKKPWKCGDCGKAFSYCSAFILHQRIHTGEKPFACPECGKAFSQSVHLTLHQRTHTGEKPYACHECGKAFSQGSYLASHWRTHTGEKPHRCADCGKAFTRVTHLTQHRRVHTGERPYACAQCAKAFRNRSSLIEHQRIHTGEKPYECSACAKAFRFSSALIRHQRIHTEEKPYRCGQCAKAFAQIAHLTQHRRVHTGEKPYTCQDCGALFSQSASLAEHRRIHTGEKPYACGQCAKAFTQVSHLTQHQRTHTGERPYPCHDCGKRFSNRSHLLQHRLVHTGERPYRCLQCGAAFSHVSSLIEHQKIHTGERPYKCGECGKAFSQGSSLALHQRTHTGERPYTCPECGKAFSNRSYLIQHHIVHTGEKPYECSGCGKAFSFSSALIRHQRTHADSSGRLCPAPTPDSTPGLSQGGETCQQGCPGRNPRGPAED

SEQ ID NO: 792312 - protein, 597 aa, Homo sapiens
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVMT

SEQ ID NO: 792313 - protein, 634 aa, Homo sapiens
KPIRSRHVTYTHNSLYIEKHQLVYNFRRNNGKPRIYCSIYSSKDEEVKSVARWNSEDHSLRKQTDNQTQLLLLMTKLDACLGRVCILNCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVMT

SEQ ID NO: 792314 - protein, 597 aa, Homo sapiens; identical to SEQ ID NO: 792312

SEQ ID NO: 792315 - protein, 283 aa, Homo sapiens
YDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQILKEDEVELSEPLQSVQFSSSGSKEETAFQAVIPKQIERKTCDPKVKFVKNIDLFNQLHFLFCLKQ

SEQ ID NO: 792316 - protein, 597 aa, Homo sapiens; identical to SEQ ID NO: 792312

SEQ ID NO: 792317 - protein, 324 aa, Homo sapiens
ITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQ

SEQ ID NO: 792318 - protein, 180 aa, Homo sapiens
TVPDQLSSGRTIMEVVPAEIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQ

SEQ ID NO: 792319 - protein, 103 aa, Homo sapiens
LQVGVPMTPSLGSVNLLEWLTELKETLNYMYCFVMKDITKDMNEDMYRARYGGRGMKLHAPPWVHHPPGTSTCAGIQELSDPCHFGFLWRLHCIGMIDNCVEM

SEQ ID NO: 792320 - protein, 130 aa, Homo sapiens
TNIFQEQKASMFGPFMNPCTLIVRVLSVPIHLEITNMFHFEPILQGRKSGACSLFSWPGARLQMFESLGSLSGCVSQSGADSWCSQHAACPSARSLQVSESQMVDGLFRVHRSAPNRLSSLSLFLPLKYM

SEQ ID NO: 792321 - protein, 253 aa, Homo sapiens
LNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVDDSQSSPKAWFGASPFTSFQSPRSMLKFWRT

SEQ ID NO: 792322 - protein, 72 aa, Homo sapiens
ASSKLHLTTGDSSFTFSSSLSQSGWAGKARKATLATLQPLLPPPTAVRQAMVPQAPTSSMWQVIPLPLLLVL

SEQ ID NO: 792323 - protein, 751 aa, Homo sapiens
VIILNCMRSRNPDESAKLADSIALNYQLSSKEQRAFGAKLKEIEKQHKNCENFYSFMIMKSNFDETYIENVVRNILKGQDVDSKEAQLISFLALLSSYVTDSTISVSQCEIFLGIIYTSTPWEPESLEDKMGTYSTLLIKTEVAEYGRYTGVRIIHPLIALYCLKELERSYHLDKCQIALNILEENLFYDSGIGRDKFQHDVQTLLLTRQRKVYGDETDTLFSPLMEALQNKDIEKVLSAGSRRFPQNAFICQALARHFYIKEKDFNTALDWARQAKMKAPKNSYISDTLGQVYKSEIKWWLDGNKNCRSITVNDLTHLLEAAEKASRAFKESQRQTDSKNYETENWSPQKSQRRYDMYNTACFLGEIEVGLYTIQILQLTPFFHKENELSKKHMVQFLSGKWTIPPDPRNECYLALSKFTSHLKNLQSDLKRCFDFFIDYMVLLKMRYTQKEIAEIMLSKKVSRCFRKYTELFCHLDPCLLQSKESQLLQEENCRKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 792324 - protein, 751 aa, Homo sapiens; identical to SEQ ID NO: 792323

SEQ ID NO: 792325 - protein, 72 aa, Homo sapiens
GGGGEASLPLWGVSRLGELFVSLTPRARGQRRDHRFSSVPLPAAAARWSPSRDGCVGSTGSSLRLGPMETRN

SEQ ID NO: 792326 - protein, 280 aa, Homo sapiens
MTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKIGRISIGMDSRVEWIMGILIE

SEQ ID NO: 792327 - protein, 83 aa, Homo sapiens
QCCGEGKHQAQADWYWLKNGCHIIVLAEGWLVNLGCAMGRPSFVGSNSFNQVMVQIALWTHPDKYPILYQKYRKICLASSLHL

SEQ ID NO: 792328 - protein, 99 aa, Homo sapiens
KRSQKDGGQHTYGNYHHGLHASGELLTQSRSHRPHGLRLLEVANWGKRMAGARFLHDTSRDLRASSCSSGAHPAALPRRPRGWQSQRHRLCRQSKDVDG

SEQ ID NO: 792329 - protein, 107 aa, Homo sapiens
KRSQKDGGQHTYGNYHHGLHASGELLTQSRSHRPHGLRLLEVANWGKRMAGARFLHDTSRDLRASSCSSGAHPAALPRRPRGWQSQRIDHKRRLPFKLFILWFRGLM

SEQ ID NO: 792330 - protein, 107 aa, Homo sapiens; identical to SEQ ID NO: 792329

SEQ ID NO: 792331 - protein, 95 aa, Homo sapiens
LGSAGTASYTWPLQHGDVTEASDSSHRCWIPRRECFQGSPAESASNASDTCLGRARAPLLLWSIGKPITKAGLYSKEELDPTSPWAAQQIIRGLG

SEQ ID NO: 792332 - protein, 108 aa, Homo sapiens
MGVPVPVLGLLGTTQDSRRKSAGISQKETPKKTVDMESTEVFTKKTELTEEEKNDQKHLNKINQYYQFTLPQYVKAVYQYHKIMKPWKNMKTNAYQVIPTLGSLRFLN

SEQ ID NO: 792333 - protein, 288 aa, Homo sapiens
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLI

SEQ ID NO: 792334 - protein, 386 aa, Homo sapiens
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHT

SEQ ID NO: 792335 - protein, 74 aa, Homo sapiens
TTRENGWGSAWLTLPPLAKPGSEIQGTEVGVGCWIWVGIGRLWPQGTACLGGISYSRYQFQNQGDESKLKKIPD

SEQ ID NO: 792336 - protein, 729 aa, Homo sapiens
GGFRVRARPRARVVMSLDCTSHIALGAASPAPEETYDHLSEVPVTREQLNHYRNVAQNARSELAATLVKFECAQSELQDLRSKMLSKEVSCQELKAEMESYKENNARKSSLLTSLRDRVQELEEESAALSTSKIRTEITAHAAIKENQELKKKVVELNEKLQKCSKENEENKKQVSKNCRKHEEFLTQLRDCLDPDERNDKASDEDLILKLRDLRKENEFVKGQIVILEETINVHEMEAKASRETIMRLASEVNREQKKAASCTEEKEKLNQDLLSAVEAKEALEREVKIFQERLLAGQQVWDASKQEVSLLKKSSSELEKSLKASQDAVTTSQSQYSSFREKIAALLRGRLSMTGSTEDTILEKIREMDSREESRDRMVSQLEAQISELVEQLGKESGFHQKALQRAQKAENMLETLQGQLTHLEAELVSGGVLRDNLNFEKQKYLKFLDQLSQKMKLDQMAAELGFDTRLDVVLARTEQLVRLESNAVIENKTIAHNLQRKLKTQKERLESKELHMSLLRQKIAQLEEEKQARTALVVERDNAHLTIRNLQKKVERLQKELNTCRDLHTELKAKLADTNELKIKTLEQTKAIEDLNKSRDQLEKMKEKAEKKLMSVKSELDTTEHEAKENKERARNMIEVVTSEMKTLKKSLEEAEKREKQLADFREVVSQMLGLNVTSLALPDYEIIKCLERLVHSHQHHFVTCACLKDVTTGQERHPQGHLQLLH

SEQ ID NO: 792337 - protein, 729 aa, Homo sapiens; identical to SEQ ID NO: 792336

SEQ ID NO: 792338 - protein, 121 aa, Homo sapiens
GWILALSPRLECSGLISAHCNFPLPGSSDSPALAFRIAGNTSVCHHVWLIFVFLVETGFHHVGQAGLELLESACLGLPKCWDYRCEPLHLAKGPILSEAFTIVPGKAVSSTLLNYNESCFV

SEQ ID NO: 792339 - protein, 258 aa, Homo sapiens
AQIVAYPACAAAIASAHRRSMGVQGFQEFLEKRCPGAVVPVDLLKLARTVSRQQQQQHLHRQLPPTAALAPGAPRAARGSVPLQPPLPPAALGAYSGGAGPTRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKQAAML

SEQ ID NO: 792340 - protein, 260 aa, Homo sapiens
AQIVAYPACAAAIASAHRRSMGVQGFQEFLEKRCPGAVVPVDLLKLARTVSRQQQQQHLHRQLPPTAALAPGAPRAARGSVPLQPPLPPAALGAYSGGAGPTRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKPFSVFRV

SEQ ID NO: 792341 - protein, 258 aa, Homo sapiens; identical to SEQ ID NO: 792339

SEQ ID NO: 792342 - protein, 1248 aa, Homo sapiens
MIPSNSTRLPVAYQGNQGLNQSFSEQQVDWTQQCISKGLTYPDYRPPPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSQEMLSSEIRTSFQQQWQNPNENVSTIGNFTNLKVNTNSKQPFNGPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYKSKIQNENMLLLALLSQARKTQKTVLKDANQTIQDSKPDSCEMNPNTQMTGNQLNLKNMETPSTSNVSGRVLDNSFCSGQESSTKGMPAKSDSSCSMEVLATCLSLWKKQPSDTAKEKECDKLRTNTTAVGISKPANIHVKSPCSVVGNSNSQNKISNPSQQTALSMVMHNYESSGINITKGTELQIAVVSPLVLSEVKTLSVKGITPAVLPETVYPVIKEGSVCSLQNQLAENAKATAALKVDVSGPVASTATSTKIFPLTQKEKQNESTNGNSEVTPNVNQGKHNKLESAIHSPMNDQQISQESRNSTVVSSDTLQIDNICSLVEGDTSYNSQIAKIFSSLPLKMVEPQKPSLPNQQGIGSREPEKQLDNTTENKDFGFQKDKPVQCTDVSHKICDQSKSEPPLESSFNNLETNRVILEKSSLEHATEKSTANDTCSSAAIQEDIYPQEIDASSNYTPQDPARNEIHSDKAPVLYLHDQLSELLKEFPYGIEAVNTREGSVGQQTTYQTSEDQTADKTSSDSKDPADQIQITILSSEQMKEIFPEQDDQPYVVDKLAEPQKEEPITEVVSQCDLQAPAAGQSRDSVILDSEKDDIHCCALGWLSMVYEGVPQCQCNSIKNSSSEEEKQKEQCSPLDTNSCKQGERTSDRDVTVVQFKSLVNNPKTPPDGKSHFPELQDDSRKDTPKTKHKSLPRTEQELVAGQFSSKCDKLNPLQNHKRKKLRFHEVTFHSSNKMTASYEQASQETRQKKHVTQNSRPLKTKTAFLPNKDVYKKHSSLGQSLSPEKIKLKLKSVSFKQKRKLDQGNVLDMEVKKKKHDTQDAEKNDLASKGHSPHPQRLK

SEQ ID NO: 792343 - protein, 60 aa, Homo sapiens
FLQVLKTRHQRELTAKWPGVPLHEWRLSQSPAAGALVAGPHTHTHTHTHTHTHTHPFLYF

SEQ ID NO: 792344 - protein, 144 aa, Homo sapiens
GWDRERKQLCFHADPDPLWGGVSKLVAEIGDLKNILSYPTAKVDDSNVSNPVYRNNGVVNQFVNSLWTLKSEILSTGTTGIHKVRILCCVTFSNKEVGQSAAQLMLNYNSISVHNVACNSCQPSGDTFEFGHLGNVPSFTSCCF

SEQ ID NO: 792345 - protein, 102 aa, Homo sapiens
VVITVTIITITFTIITTTIIITITITTIIIIIIIITTPAPLTIIIIIITITTTIITIIIIYFTIEVPRACDLPKIPFPVRAGVNTLVQVSQLQKKWTFFSSW

SEQ ID NO: 792346 - protein, 94 aa, Homo sapiens
PRAADVPRPFGSSLVQLKPWLRGRGTAWEGLGEILGSPLALTNVATRGRKVAEPGLGQDALCWVGANTRKEAWAIGKLPLVLGQPAAALRLLLF

SEQ ID NO: 792347 - protein, 94 aa, Homo sapiens; identical to SEQ ID NO: 792346

SEQ ID NO: 792348 - protein, 123 aa, Homo sapiens
RMLVLSFLTGGQSPSSFWEDSSNYGGGGACRAAVPRGVWGSWGSRGSFFFIAQIPKPVTLRIFVFLATFQSEALVERAELEPDGRVVGEEWVEGTWRMFQVVSLFLAPYFAYWSFPVCSRRPL

SEQ ID NO: 792349 - protein, 90 aa, Homo sapiens
GYWMNVANSTSNTHLTRATRRIRQSNREGVVFQFFSARTYVDIRYCLNTLTGSDTPIRSGKFLTVARSPPEIAQVSTTDDSSPRSPISEM

SEQ ID NO: 792350 - protein, 148 aa, Homo sapiens
SRSSSSSGAEKRTRVCVRVCVCVCVCVCARWGRAQRTAGRRVRFAGRSVLGRVPQGPQRLLRRRGSCSGSCAPWPTPWRARADPLGYSTLLPPPLANASSLQLPPSPAPPSLAPNANPATDDQPSRLRSPPADHNGSPCDTLAGEFYS

SEQ ID NO: 792351 - protein, 111 aa, Homo sapiens
MAREECKALLDGLNKTTACYHHLVLTVGGSADSQNLRQELQKTRQKAQELAVSTCARLTAVLRDRGLAADERAEFERLWVAFSGCLDLLEADMRRALELGAAFPLHAPRRP

SEQ ID NO: 792352 - protein, 444 aa, Homo sapiens
PEQKQVFANPSPTQKSPVQPVEDLAGNLWEKLREKIRSFVAYSIAIDEITDINNTTQLAIFIRGVDENFDVSEELLDTVPMTGTKSGNEIFLRVEKSLKKFCINWSRLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLVSRNESDGLNYIPKIAELKTEFQKRLSDFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 792353 - protein, 129 aa, Homo sapiens
PQRPFPTPPQPALGGTAPRPRLVVVVLLLPARAVVALSAAAADRGRAHRVDLLVSPERGALHEALPALHADVGRLLAPRRPEPVPVLGPLVRQEPGPVPEALPALQTHVRLGGRGAPRPGPRGLCPRAR

SEQ ID NO: 792354 - protein, 132 aa, Homo sapiens
CCDPRNLGTLTKLRCSEGRGCGHVFDSHGTLMKTLPAPCLGYSYWKPGHTGPGRGGGAQKGPQSKRGKMLPPLPPISERPLSPGLTLLTRIDSILPRNTFTQCKRSGLILKPPKLPCVYIFMSASDAAHFER

SEQ ID NO: 792355 - protein, 196 aa, Homo sapiens
CFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGT

SEQ ID NO: 792356 - protein, 92 aa, Homo sapiens
MVLAFQLVSFTYIWIILKPNVCAASNIKMTHQRCSSSMKQTWLECGGPIIVHYNLKHLCSSGPPTSTSQVAGTTGVCHYTWLLYFFGRDWVS

SEQ ID NO: 792357 - protein, 109 aa, Homo sapiens
MWLLVSVILISRISSVGGEATFCDFPKINHGIYIVSRQMSKYPSGERVRYQCRSPYEMFGDEEVMCLNGNWTEPPQCKDSTGKCGPPPPIDNGDITSFSVVSICSSFIS

SEQ ID NO: 792358 - protein, 330 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 792359 - protein, 312 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTFCVNPPTVLRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 792360 - protein, 312 aa, Homo sapiens
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAYIVSRQMSKYPSGERVRYQCRSPYEMFGDEEVMCLNGNWTEPPQCKDSRCQYMLQLHQLKYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 792361 - protein, 165 aa, Homo sapiens
MQVGSAANAVCRARLSCTDGSPTHKARLTCPRASNFDIPAPPWGSRTSPSCLCPTAPLWPSSDDGVKSGELRSQLPSTPPGFLDTNISLSVSLHLGMSEEWTGGNSLQLLRAERDGWRDRKMDHERGRGPQAAPALSRSQKLLEATHSREMNNVRGGGFTPGLDI

SEQ ID NO: 792362 - protein, 71 aa, Homo sapiens
WFHRVGPADSLDSGIERERWNQDEHLEERGCHLPSLGNKPKNFILGMSHLRSPWRCRVLSWLPDLELRRVV

SEQ ID NO: 792363 - protein, 165 aa, Homo sapiens
VVEPQAFLGLRQIRLLNLSNNLLSTLEESTFHSVNTLETLRVDGNPLACDCRLLWIVQRRKTLNFDGRLPACATPAEVRGDALRNLPDSVLFEYFVCRKPKIRERRLQRVTATAGEDVRFLCRAEGEPAPTVAWVTPQHRPVTATSAGRARVLPGGTLEIQDARP

SEQ ID NO: 792364 - protein, 235 aa, Homo sapiens
PKYEVLVATKFTPKRDNPEQFLEAAATSLQALSPQKQSFVLEVLSGCLEYRKLLTVVVDAFYVEDGRLCLRVDHSRFEVICYLATFLLEELGFQLFCNIIKSQPVDKMCKFLRFFFNPLHLCSWIKDEWSLIYEPAHVKENWIDPPDEVPQSTYQPPKEQQQLETVKRYNRRKAEELLLRANIEELRCAMPRSCRERVQVPPSSLKTHHRGAIFSSHQKVPPNAIAVTTYVAFSH

SEQ ID NO: 792365 - protein, 113 aa, Homo sapiens
ARYPRPRTMTSLTSFPLLPTLTHQHPVVLAPALFLLQCRPPPPSPSPTSTKLSALAFLGPLPLAAADHRLFLPPLQQVPQSTYQPPKEQQQLETVKRYNRRKAEVSCVRPLPS

SEQ ID NO: 792366 - protein, 115 aa, Homo sapiens
MLRPRAGGRVGGKARDPAGSARRRPRSRLPHVSLRLGPPSLHLGGLAPRPTGRGRSSGASSAFSHRGAATHSRPVVAASLPPKPPAPAQARAPALAPAPACAAAAAGREGEGGKG

SEQ ID NO: 792367 - protein, 199 aa, Homo sapiens
KPPRKMKGLYQAAGRILVTLGILSVCSGVIAFFPVFSYKPWFTGWSVRIACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 792368 - protein, 199 aa, Homo sapiens; identical to SEQ ID NO: 792367

SEQ ID NO: 792369 - protein, 68 aa, Homo sapiens
AFSTHCPVYPSSLSPQQQPLDHPSGLGCILRPTLPSEEWTLGREVLIRERAGSEQRGRQPEEGQNHGL

SEQ ID NO: 792370 - protein, 166 aa, Homo sapiens
PRKCFPDRLLCRAWWVRIGLAAHSICVSYRDLFLSCTGNPEAEGPGSGHWHVFCFTRKQRSPISHLNLCHQLGCCPCPCDTCTCHIHLCTELSLVTTSHQTGTGRCSLFGPVCVPARCSVIPMEGGSKPCHKHPELSSDVLLGLNPASQVFRPETTEEVGRPPPWI

SEQ ID NO: 792371 - protein, 87 aa, Homo sapiens
SGASPRTYEQRAVFPAPWGRLPGESATVAAHGEMKSRSVAQAGMQWRDLGSLQPLPPGFGRFSCLGLLSSWDYRCVPPRTANFCIFS

SEQ ID NO: 792372 - protein, 87 aa, Homo sapiens; identical to SEQ ID NO: 792371

SEQ ID NO: 792373 - protein, 798 aa, Homo sapiens
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 792374 - protein, 798 aa, Homo sapiens; identical to SEQ ID NO: 792373

SEQ ID NO: 792375 - protein, 142 aa, Homo sapiens
FEIGVLLLLLGLECNGNISAHCNLCLLGSSSSPPQPGIQGSDLAPIPPLNAAKTPAVGWIIFPPSNLCSHHVLQNTLPTPVSGKILKVSLKCHLPQTNKATLLLNAPTAFAYASKVSELHMHLSILEKGKLPKGRSYDLQLT

SEQ ID NO: 792376 - protein, 73 aa, Homo sapiens
LPSPSPCSLGSLLGVLGRLLDKLKPRTAATLPIITLAAVGKLAVFWKTACLECLASSQASDSPLGMQKVCIAV

SEQ ID NO: 792377 - protein, 248 aa, Homo sapiens
REKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 792378 - protein, 108 aa, Homo sapiens
DRFQPFPGCTHQASSSSPGLGILFLYGTVRNQYFQSRTPFYSENPSEELLHLPPTPTHTHTHTHTHMHTHTGSLKAEKGAECGIQGSDDTHNNAVTPGCCRAEQRKCL

SEQ ID NO: 792379 - protein, 120 aa, Homo sapiens
LVALAGVQWHNGAISAHRNLRLLGSSDSPASASQVAGITGTRHHHAWLIFVFLVETGFHHVGQAGLKLLTSGDAPCLGLPKCWDYRREPPHPARGSLLRHVKCRWDRLETRRHPATQHSA

SEQ ID NO: 792380 - protein, 506 aa, Homo sapiens
MAGEVSAATGRFSLERLGLPGLALAAALLLLALCLLVRRTRRPGEPPLIKGWLPYLGVVLNLRKDPLRFMKTLQKQHGDTFTVLLGGKYITFILDPFQYQLVIKNHKQLSFRVFSNKLLEKAFSISQLQKNHDMNDELHLCYQFLQGKSLDILLESMMQNLKQVFEPQLLKTTSWDTAELYPFCSSIIFEITFTTIYGKVIVCDNNKFISELRDDFLKFDDKFAYLVSNIPIELLGNVKSIREKIIKCFSSEKLAKMQGWSEVFQSRQDVLEKYYVHEDLEIGAHHLGFLWASVANTIPTMFWAMYYLLRHPEAMAAVRDEIDRLLQSTGQKKGSGFPIHLTREQLDSLICLESSIFEALRLSSYSTTIRFVEEDLTLSSETGDYCVRKGDLVAIFPPVLHGDPEIFEAPEEFRYDRFIEDGKKKTTFFKRGKKLKCYLMPFGTGTSKCPGRFFALMEIKQLLVILLTYFDLEIIDDKPIGLNYSRLLFGIQYPDSDVLFRYKVKS

SEQ ID NO: 792381 - protein, 68 aa, Homo sapiens
HVCFVSSSCILCVNTCAGWKILLTFCECLHEDLPLVNGSPYFLCVCISTVFGGDSLHAVCVYMDANVC

SEQ ID NO: 792382 - protein, 465 aa, Homo sapiens
MLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKVHESQGSDSSPAASSGYESSTPPAIASANSKDTTKTPSAVQTSTSHNPGLPPNFNEWYV

SEQ ID NO: 792383 - protein, 102 aa, Homo sapiens
CLPKCWDNKCEPPRLAQSLSFTFGHHQAKGCRQVLRSSVWGHLHQISPQPQNASQKGLAVGGCPLAPSSCEPLTVAMTQAWLCWPLAGWGLSPNSWCFLPVL

SEQ ID NO: 792384 - protein, 140 aa, Homo sapiens
MLGELLGEGLLILVTLGVQFVKFIVLYADSRFYVSYTFRVKKCTFFFLRQSLPLLSRLQCSGTISAHCNLRLPGSSSSPASTSRVAGITDAHHHARLIFLFLVETGFRHVGQAAVKLLTSGDPPSSASQSAGITGMSHLA

SEQ ID NO: 792385 - protein, 115 aa, Homo sapiens [sequence omitted]

SEQ ID NO: 792386 - protein, 84 aa, Homo sapiens
SILHIPSSSAFPPVLFPIVFPGRWEPFNTNGAGDALIHMHPNTTPTPQALSSPVTDITFYGHIFISLSYNYGQGNDELCGDFKT

SEQ ID NO: 792387 - protein, 278 aa, Homo sapiens
HGGSRDPGTVTIPPAMWELRSASFWRAIFAEFFATLFYVFFGLGSSLRWAPGPLHVLQVAMAFGLALATLVQSVGHISGAHVNPAVTFAFLVGSQMSLLRAFCYMAAQLLGAVAGAAVLYSVTPPAVRGNLALNTLHPAVSVGQATTVEIFLTLQFVLCIFATYDERRNGQLGSVALAVGFSLALGHLFGMYYTGAGMNPARSFAPAILTGNFTNHWVYWVGPIIGGGLGSLLYDFLLFPRLKSISERLSVLKGAKPDVSNGQPEVTGEPVELNTQAL

SEQ ID NO: 792388 - protein, 131 aa, Homo sapiens
MEIFLTLQFVLCIFATYDERRNGQLGSVALAVGFSLALGHLFGMYYTGAGMNPARSFAPAILTGNFTNHWVYWVGPIIGGGLGSLLYDFLLFPRLKSISERLSVLKGAKPDVSNGQPEVTGEPVELNTQAL

SEQ ID NO: 792389 - protein, 162 aa, Homo sapiens
ISSSSPLLNSAEDAEKQLQDLTELLRGPRETYQHPGKDKTSGVHLASPGCRVWPPPPFTFPSLGSKVTPKPRQSSRKPKASEPTGQLPTPLLGRTGVGEADPPRSRLTQLQGLVAPEQRGLRLLLALQAPRLACQPAQPALGREALLQQAAQHHVHAPHLRP

SEQ ID NO: 792390 - protein, 57 aa, Homo sapiens
MRAAKPVPAPTSAHARPVPSLPPCSAPMVRSAPGAGPGGISLAQEWRLSYLLPSLGD

SEQ ID NO: 792391 - protein, 100 aa, Homo sapiens
LEVHHSSFAILMSSELLQGKGFPPPQACSNPPKTKKETCRSNKERSVMELSWVQAGSSRPGVLESRDELSRQHGIVSELRPWQVRLLHLAGCLHVGRFCG

SEQ ID NO: 792392 - protein, 116 aa, Homo sapiens
PPWGLQVWVLCVPRGQAKTRLEPAGRAPEAPLPALSVLAGGSDSDSRFRQSLSSAAAPGADSLGARTELRVEPGPCAPPSPSPSPSPELDHREHRRRQPQSRGCAGKRKRKRGLRS

SEQ ID NO: 792393 - protein, 94 aa, Homo sapiens
SLCNKSLCRRSPFCSQQRARCKFCGLHLLSACRPAGQKTVSHLQFNRPTHSSPPSHGKSLQAELSGLARNPSSEGASPLWLSASSETGISPPTA

SEQ ID NO: 792394 - protein, 67 aa, Homo sapiens
NPPTSASQSAGITGMSHHASIMYNRNLVERKDGTTSRRRKGIQARWMKLNKTESIPNSRYKCRIQAD

SEQ ID NO: 792395 - protein, 367 aa, Homo sapiens
GVWWQHAQYHAPALPQAAWWTVWGLHLLCLPSRLPDGVWLLELSHNNLSHLPAGAFQGFWGLRVLLLSLNILRDLSDGALGGLSFLEQLNLSHNQLAHLPTDFSATLGSLLCLDLSHNLLTSLDPTSLWRLGGLEQLNLSHNQLAELAAGVFGGLFHLHWLSLAGNQLQRVKGAALTTVPGLEVLSVAGNDISELEAEAFATLEHWAFSLLGNRLQHLEVKAVAGIRTAGMRLLLLDNPWTRDCDLQGAFGKLGHLRHLSVVDLGILTCAGPERLSGAVLSGVEAQLCLAETATVLGITGTVLLTVAVAVLMAERKRRQGPQEAGELGSFLERLFNQQADQQAKISTITANLNADEWITTWSNLAMR

SEQ ID NO: 792396 - protein, 112 aa, Homo sapiens
PGRRVRPTCSRASARSCRCLWPAPTPPAPRGALEEAASALAQGNEVLNESQLAGLTSGLCSCCSPAWSALITRCLSSPHTPGMSIRCFVDPMLCAQGDKACTHGAVSTCSSW

SEQ ID NO: 792397 - protein, 120 aa, Homo sapiens
MRLPMKIFFGTETKQNKKAQPTLNLFSLAQPMCHYKPSRALPQQGLCFGALHDAICLSADTTLRCLQSQSQVKKWGYCVDYFRSEYRPKKTKLVLFEIAWLPSFCHLTLHGEILLQELPK

SEQ ID NO: 792398 - protein, 90 aa, Homo sapiens
REGIGLSQEAVSSWEAGSNPTPGLKYLPPLAGSGPHGKAEGRSSRVAIPRTGVTGPTSTHVSQLMHRRASWSLPGQGPQPQTQQLPLRPP

SEQ ID NO: 792399 - protein, 153 aa, Homo sapiens
QGSVLGGRGSGEKGAAGMWGWGQPALGQEMTPGPPVMVTLLVRMSRRTAERGGKRVSAGTGVGASRVGSTEGFGLLIPAWELRPVPSLPARQLRSQLQPGSHTHTCAHTHAHTHTHPCTHACTHTHVGAQTTPQRPSWGHGVHLPQASLHLSV

SEQ ID NO: 792400 - protein, 152 aa, Homo sapiens
TPPTCLPGPRAAISTGMWGWGQPALGQEMTPGPPVMVTLLVRMSRRTAERGGKRVSAGTGVGASRVGSTEGFGLLIPAWELRPVPSLPARQLRSQLQPGSHTHTCAHTHAHTHTHPCTHACTHTHVGAQTTPQRPSWGHGVHLPQASLHLSV

SEQ ID NO: 792401 - protein, 84 aa, Homo sapiens
PQPHLQHTRTSKRLNRSGQVFLQNLLPQELATRAGNLATGPMNARSPGFLLSRIPSVWDPTENRTVQLTWQPLPEPLELWPKAL

SEQ ID NO: 792402 - protein, 98 aa, Homo sapiens
SWLLWRPAGNGTSKRNYVWKAVVQGHFAGYKRGLRNQREHTALLKIEGVYARDETEFYLGKRCAYVYKAKKDLEDLLFKEKLKSKKESESQQYQQSQI

SEQ ID NO: 792403 - protein, 30 aa, Homo sapiens
MHNLVTLLVSKPTHLRVNVPYCTPTPYRLH

SEQ ID NO: 792404 - protein, 272 aa, Homo sapiens
PPAPPFPAAPGPWLRRPLFSLKLSDTEDVFPRRAGPLEVPADSRVFVQAALARPSPRWGLALHRCSVTPSSRPAPGPALALLREGCPADTSVAFPPPPPPSPGAARPARFSFRLRPVFNASVQFLHCQLSRCRRLRGVRRAPAPLTPPPPPPPSRCLPQDEACADTGSGSAEGLAADGPHLHTLTQPIVVTVPRPPPRPPKSVPGRAVRPEPPAPAPAALEPAPVVALVLAAFVLGAALAAGLGLVCAHSAPHAPGPPARASPSGPQPRRSQ

SEQ ID NO: 792405 - protein, 270 aa, Homo sapiens
MKSETKDKVRLRHYEKSEANKPDNLAETKDKVRLRHYEKSEVNKLDNLAETKDKVRLRHYEKSEANKLDNLAETKDKVRLRHYEKSQANKLDNLAETKDKVRLRHYEKSQANKLDNLAETKDKVRLRHYEKSQANKLDNLAETKDKVRLRHYEKSQANKPDNLAETKDKVRLRHYEKSQVNKLDNLAETKDKVRLWHYEKSQANKLDNLAETKDKVRLRHYEKSQANKLDNLAETKDKVRLRHYEKSQANKLDNLAETKDKVRLWHYEKS

SEQ ID NO: 792406 - protein, 108 aa, Homo sapiens
MTKSHMIISIDAERAFDKIQHHFMLKTLNNLGIDGTYLKIIRAVYDKPTVNITLNGQKLEPFPLKTSRRQGCPLSPLLFNTVLEVLARAIRQEKEIKGIQLGKEEVKL

SEQ ID NO: 792407 - protein, 91 aa, Homo sapiens
GRGPRAGRHPNVAPSQLTTPLARCPAGVHHHMPTRKPRGGGPSAEPTALASVDMPPPYPSREQMTPRERPTVYPEVQACRGHSEVGCPSAS

SEQ ID NO: 792408 - protein, 179 aa, Homo sapiens
GGAAVAQGPPAGPGRGGWALLATFLLSLLSEKFVRCQPSSQLGTEQETSPASLAGVAAGVSVACAGQDARPTGLPLRGPHQPPHSRSPGRRERRGWTSGKAWRAASGKPSGLLPPPSTGESQATVNEEQRAGETSASAQEQRPATPPTGDPVDALVATLPGSPSPSEPERISVPLLLGA

SEQ ID NO: 792409 - protein, 158 aa, Homo sapiens
GFESSLSPGLALSPHSALASSHLKCLLFCHEVPRVFSSLNVLFMFQVVLGIYYVLRTSMSVSVGVVLYFISLCGLCLVLSESTVGLRGPCPREETCVCLDCPGQPALGQKEWTPRDPRRLCPRHSPSPPPAGSVGGLKPSCLLGRQQFWKSKADTTEG

SEQ ID NO: 792410 - protein, 133 aa, Homo sapiens
METNINWGARVFLADFQAQKVITNPAGKGLGEVLKVKTTAVNFQHKGIPPKNHLGALLNLYCFFQHKNNFRGDWGFQSSLALTASWEQHGSFPNHGGVNAGLWGKKSLMGGNKWALALQMVPSPPLTGILLAL

SEQ ID NO: 792411 - protein, 52 aa, Homo sapiens
MRSGVQPGQYDETLSLLKIQKISQAWCQVPVVPATQEAETGESLEPRKRRLQ

SEQ ID NO: 792412 - protein, 111 aa, Homo sapiens
VLGPSLWQLLRRRTGPRRRERRGGATPRRECAGTAGPSRTRRATEARSPLQGAGAEPRPPSRRRSVHCSFRCLPGAGRREARAAETPAGREGRGVNGSQLRAPEDNDHSPS

SEQ ID NO: 792413 - protein, 49 aa, Homo sapiens
LEDPKHCGLILESAMTAVNTASYHCPFVGLTLFYSLFVKMGTAARNSVI

SEQ ID NO: 792414 - protein, 106 aa, Homo sapiens
AEDKLLGHLGTAAKCGRSQGHYANMRNTFFSLDNQPGRVKNYRDKRSQCYPTAKSEITGCLEGLEWLKKLNIYMDIHVRICMCVYVYICNILYIYMHIFKRSPKMC

SEQ ID NO: 792415 - protein, 176 aa, Homo sapiens
TAQLPGASIETLKGMYRLESRSAGALVIEESEGLRMEVLMHFSVYQASSMSLFCGNHPSVDCIMWSLHYMLREEPNLEGALSHPPVNPAPWDPGACEASMHFLSRQPLRQGLKRASCDRRMAGVEAGSAPRIPPGSGFRLEIQAEANLQPPELSQTPRQHGAPAAWSRTWEGGLLA

SEQ ID NO: 792416 - protein, 136 aa, Homo sapiens
DGVLLSLPRLECNGTISAHCNLRLPGSSNSPVSASRVARITEACHHAWLICVFLVETGFHHIGQAGLKVLTSGDLPTSASQSAGITGVSHCAQPEQTFLRSQSLQYFLLRSLPLLLAYKSFSIQKSNIYLFSFKML

SEQ ID NO: 792417 - protein, 164 aa, Homo sapiens
STMLSRRKTFDQKREMRKRLSSEKCLPVPRLRGPHARLAPTEAGHPPGPTRRHSAPWTRGGPGPPRGRPPHTAFAPRGPLAAEADGAPLPGPWGPRLPRADSFDSARASASSCGRTPRTQPAPLFTQGRPGGAGRDPGTRSRPETLSSGPPLAAPAPGAGPDPT

SEQ ID NO: 792418 - protein, 180 aa, Homo sapiens
GRRQRLLGPGQVSAAQARPYLSTVRASGQQRAPEDHERPAEESAPAPMPSSAPRGPTEPALRRPSSAERPLAPGPSSSPGAGRAPGAMASPSGSSEAPGKPRGRDGRPRREEDDVPPEEKRLRLLLEGGSAQPQDCEDGQDAPRSARKETGTQTGGDGRGVTVAHTCNPSTLAGRGWWIT

SEQ ID NO: 792419 - protein, 197 aa, Homo sapiens
GRRQRLLGPGQVSAAQARPYLSTVRASGQQRAPEDHERPAEESAPAPMPSSAPRGPTEPALRRPSSAERPLAPGPSSSPGAGRAPGAMASPSGSSEAPGKPRGRDGRPRREEDDVPPEEKRLRLLLEGGSAQPQDCEDGQDAPRSARKETGTQTGGDGRGVFTLLCNESQKYIIELTARYLTHKRLHKWDSASGKWW

SEQ ID NO: 792420 - protein, 103 aa, Homo sapiens [sequence omitted]
